United States Patent 9,504,740 (HAEMOPHILUS PARASUIS VACCINE SEROVAR TYPE FOUR) - sequence listing, part 3

SEQ ID NO: 3 - DNA, 2216818 bp, Haemophilus parasuis
  misc_feature (2195)..(2294): n is a, c, g, or t
  misc_feature (4640)..(4739): n is a, c, g, or t
  misc_feature (6005)..(6104): n is a, c, g, or t
  misc_feature (9144)..(9222): n is a, c, g, or t
  misc_feature (12168)..(12267): n is a, c, g, or t
  misc_feature (12729)..(12828): n is a, c, g, or t
  misc_feature (14615)..(14722): n is a, c, g, or t
  misc_feature (15240)..(15339): n is a, c, g, or t
  misc_feature (17758)..(17777): n is a, c, g, or t
  misc_feature (19242)..(19598): n is a, c, g, or t
  misc_feature (26142)..(26241): n is a, c, g, or t
  misc_feature (26671)..(26772): n is a, c, g, or t
  misc_feature (27954)..(28053): n is a, c, g, or t
  misc_feature (28867)..(28966): n is a, c, g, or t
  misc_feature (29336)..(29435): n is a, c, g, or t
  misc_feature (30184)..(30283): n is a, c, g, or t
  misc_feature (31084)..(31203): n is a, c, g, or t
  misc_feature (34578)..(34654): n is a, c, g, or t
  misc_feature (35834)..(35933): n is a, c, g, or t
  misc_feature (38307)..(38406): n is a, c, g, or t
  misc_feature (40120)..(40219): n is a, c, g, or t
  misc_feature (40440)..(40479): n is a, c, g, or t
  misc_feature (40762)..(40861): n is a, c, g, or t
  misc_feature (41065)..(41093): n is a, c, g, or t
  misc_feature (41315)..(41414): n is a, c, g, or t
  misc_feature (44947)..(45046): n is a, c, g, or t
  misc_feature (45177)..(45230): n is a, c, g, or t
  misc_feature (45959)..(45968): n is a, c, g, or t
  misc_feature (46095)..(46144): n is a, c, g, or t
  misc_feature (46410)..(46819): n is a, c, g, or t
  misc_feature (47880)..(47898): n is a, c, g, or t
  misc_feature (49736)..(58627): n is a, c, g, or t
  misc_feature (58795)..(58837): n is a, c, g, or t
  misc_feature (62561)..(62565): n is a, c, g, or t
  misc_feature (64054)..(64161): n is a, c, g, or t
  misc_feature (64646)..(64731): n is a, c, g, or t
  misc_feature (66302)..(66435): n is a, c, g, or t
  misc_feature (66460)..(66492): n is a, c, g, or t
  misc_feature (67187)..(67286): n is a, c, g, or t
  misc_feature (69172)..(69271): n is a, c, g, or t
  misc_feature (69818)..(69944): n is a, c, g, or t
  misc_feature (70331)..(70434): n is a, c, g, or t
  misc_feature (70759)..(70858): n is a, c, g, or t
  misc_feature (72602)..(72701): n is a, c, g, or t
  misc_feature (74654)..(74659): n is a, c, g, or t
  misc_feature (74710)..(74718): n is a, c, g, or t
  misc_feature (75837)..(75851): n is a, c, g, or t
  misc_feature (76298)..(76397): n is a, c, g, or t
  misc_feature (79914)..(80013): n is a, c, g, or t
  misc_feature (80606)..(80708): n is a, c, g, or t
  misc_feature (82810)..(82909): n is a, c, g, or t
  misc_feature (85989)..(86088): n is a, c, g, or t
  misc_feature (86382)..(86481): n is a, c, g, or t
  misc_feature (90973)..(91072): n is a, c, g, or t
  misc_feature (92954)..(93053): n is a, c, g, or t
  misc_feature (97794)..(98074): n is a, c, g, or t
  misc_feature (98248)..(98347): n is a, c, g, or t
  misc_feature (99267)..(99366): n is a, c, g, or t
  misc_feature (99821)..(99920): n is a, c, g, or t
  misc_feature (101111)..(101528): n is a, c, g, or t
  misc_feature (101601)..(101614): n is a, c, g, or t
  misc_feature (101835)..(102073): n is a, c, g, or t
  misc_feature (102805)..(102904): n is a, c, g, or t
  misc_feature (104051)..(104150): n is a, c, g, or t
  misc_feature (108168)..(108267): n is a, c, g, or t
  misc_feature (112958)..(113057): n is a, c, g, or t
  misc_feature (114104)..(114122): n is a, c, g, or t
  misc_feature (115568)..(115667): n is a, c, g, or t
  misc_feature (115947)..(116046): n is a, c, g, or t
  misc_feature (116423)..(116522): n is a, c, g, or t
  misc_feature (116848)..(116947): n is a, c, g, or t
  misc_feature (120500)..(120599): n is a, c, g, or t
  misc_feature (122366)..(122470): n is a, c, g, or t
  misc_feature (125427)..(125553): n is a, c, g, or t
  misc_feature (125628)..(125628): n is a, c, g, or t
  misc_feature (127476)..(127575): n is a, c, g, or t
  misc_feature (129093)..(129192): n is a, c, g, or t
  misc_feature (130337)..(130436): n is a, c, g, or t
  misc_feature (130700)..(130807): n is a, c, g, or t
  misc_feature (131035)..(131134): n is a, c, g, or t
  misc_feature (132275)..(132376): n is a, c, g, or t
  misc_feature (135611)..(135710): n is a, c, g, or t
  misc_feature (136498)..(136597): n is a, c, g, or t
  misc_feature (139676)..(139792): n is a, c, g, or t
  misc_feature (141253)..(141352): n is a, c, g, or t
  misc_feature (144097)..(144196): n is a, c, g, or t
  misc_feature (145102)..(145201): n is a, c, g, or t
  misc_feature (145593)..(145692): n is a, c, g, or t
  misc_feature (149794)..(149893): n is a, c, g, or t
  misc_feature (150176)..(150275): n is a, c, g, or t
  misc_feature (150615)..(150765): n is a, c, g, or t
  misc_feature (151063)..(151162): n is a, c, g, or t
  misc_feature (152337)..(152442): n is a, c, g, or t
  misc_feature (154412)..(154511): n is a, c, g, or t
  misc_feature (155162)..(155276): n is a, c, g, or t
  misc_feature (156655)..(156671): n is a, c, g, or t
  misc_feature (157339)..(157438): n is a, c, g, or t
  misc_feature (158778)..(158791): n is a, c, g, or t
  misc_feature (159394)..(159409): n is a, c, g, or t
  misc_feature (159559)..(159692): n is a, c, g, or t
  misc_feature (159878)..(159898): n is a, c, g, or t
  misc_feature (159959)..(159976): n is a, c, g, or t
  misc_feature (160118)..(160263): n is a, c, g, or t
  misc_feature (160356)..(160368): n is a, c, g, or t
  misc_feature (160606)..(160673): n is a, c, g, or t
  misc_feature (160816)..(160931): n is a, c, g, or t
  misc_feature (161171)..(161174): n is a, c, g, or t
  misc_feature (161286)..(161366): n is a, c, g, or t
  misc_feature (161451)..(161595): n is a, c, g, or t
  misc_feature (161965)..(161970): n is a, c, g, or t
  misc_feature (163844)..(163943): n is a, c, g, or t
  misc_feature (164666)..(164765): n is a, c, g, or t
  misc_feature (166356)..(166422): n is a, c, g, or t
  misc_feature (166524)..(166566): n is a, c, g, or t
  misc_feature (166646)..(166680): n is a, c, g, or t
  misc_feature (166737)..(166977): n is a, c, g, or t
  misc_feature (167004)..(167024): n is a, c, g, or t
  misc_feature (167107)..(167119): n is a, c, g, or t
  misc_feature (167153)..(167169): n is a, c, g, or t
  misc_feature (167397)..(167424): n is a, c, g, or t
  misc_feature (167475)..(167487): n is a, c, g, or t
  misc_feature (167535)..(167637): n is a, c, g, or t
  misc_feature (171474)..(171591): n is a, c, g, or t
  misc_feature (174569)..(174668): n is a, c, g, or t
  misc_feature (175487)..(175586): n is a, c, g, or t
  misc_feature (176717)..(176816): n is a, c, g, or t
  misc_feature (176860)..(176877): n is a, c, g, or t
  misc_feature (177295)..(177394): n is a, c, g, or t
  misc_feature (177635)..(177734): n is a, c, g, or t
  misc_feature (178414)..(178519): n is a, c, g, or t
  misc_feature (181233)..(181332): n is a, c, g, or t
  misc_feature (181554)..(181653): n is a, c, g, or t
  misc_feature (181900)..(181999): n is a, c, g, or t
  misc_feature (185708)..(185809): n is a, c, g, or t
  misc_feature (188073)..(188172): n is a, c, g, or t
  misc_feature (189988)..(190087): n is a, c, g, or t
  misc_feature (194064)..(194163): n is a, c, g, or t
  misc_feature (195985)..(196084): n is a, c, g, or t
  misc_feature (200636)..(200647): n is a, c, g, or t
  misc_feature (203434)..(203533): n is a, c, g, or t
  misc_feature (204543)..(204644): n is a, c, g, or t
  misc_feature (205265)..(205364): n is a, c, g, or t
  misc_feature (207358)..(207496): n is a, c, g, or t
  misc_feature (208499)..(208598): n is a, c, g, or t
  misc_feature (210043)..(210142): n is a, c, g, or t
  misc_feature (210409)..(210416): n is a, c, g, or t
  misc_feature (215313)..(215412): n is a, c, g, or t
  misc_feature (222310)..(222438): n is a, c, g, or t
  misc_feature (222561)..(222607): n is a, c, g, or t
  misc_feature (222645)..(222750): n is a, c, g, or t
  misc_feature (222785)..(222918): n is a, c, g, or t
  misc_feature (222955)..(222955): n is a, c, g, or t
  misc_feature (223018)..(223136): n is a, c, g, or t
  misc_feature (223421)..(223520): n is a, c, g, or t
  misc_feature (230368)..(230467): n is a, c, g, or t
  misc_feature (231878)..(231993): n is a, c, g, or t
  misc_feature (234613)..(234722): n is a, c, g, or t
  misc_feature (245024)..(245123): n is a, c, g, or t
  misc_feature (247379)..(247480): n is a, c, g, or t
  misc_feature (252653)..(252745): n is a, c, g, or t
  misc_feature (255046)..(255145): n is a, c, g, or t
  misc_feature (258884)..(258966): n is a, c, g, or t
  misc_feature (260223)..(260232): n is a, c, g, or t
  misc_feature (261226)..(261325): n is a, c, g, or t
  misc_feature (268411)..(268444): n is a, c, g, or t
  misc_feature (270461)..(270560): n is a, c, g, or t
  misc_feature (270820)..(270919): n is a, c, g, or t
  misc_feature (276390)..(276489): n is a, c, g, or t
  misc_feature (276876)..(276980): n is a, c, g, or t
  misc_feature (277603)..(277702): n is a, c, g, or t
  misc_feature (278706)..(278805): n is a, c, g, or t
  misc_feature (281521)..(281620): n is a, c, g, or t
  misc_feature (281828)..(281927): n is a, c, g, or t
  misc_feature (282778)..(282877): n is a, c, g, or t
  misc_feature (283250)..(283349): n is a, c, g, or t
  misc_feature (283653)..(283752): n is a, c, g, or t
  misc_feature (284188)..(284288): n is a, c, g, or t
  misc_feature (290730)..(290829): n is a, c, g, or t
  misc_feature (293801)..(293900): n is a, c, g, or t
  misc_feature (297876)..(297891): n is a, c, g, or t
  misc_feature (299832)..(299931): n is a, c, g, or t
  misc_feature (300257)..(300283): n is a, c, g, or t
  misc_feature (302426)..(302525): n is a, c, g, or t
  misc_feature (303219)..(303318): n is a, c, g, or t
  misc_feature (303539)..(303641): n is a, c, g, or t
  misc_feature (305848)..(305947): n is a, c, g, or t
  misc_feature (307005)..(307029): n is a, c, g, or t
  misc_feature (307145)..(307254): n is a, c, g, or t
  misc_feature (308215)..(308315): n is a, c, g, or t
  misc_feature (308534)..(308552): n is a, c, g, or t
  misc_feature (308721)..(308756): n is a, c, g, or t
  misc_feature (308786)..(308813): n is a, c, g, or t
  misc_feature (308846)..(308861): n is a, c, g, or t
  misc_feature (308928)..(309032): n is a, c, g, or t
  misc_feature (309126)..(309266): n is a, c, g, or t
  misc_feature (309993)..(310092): n is a, c, g, or t
  misc_feature (310668)..(310686): n is a, c, g, or t
  misc_feature (312837)..(312936): n is a, c, g, or t
  misc_feature (318060)..(318159): n is a, c, g, or t
  misc_feature (318516)..(318617): n is a, c, g, or t
  misc_feature (320167)..(320266): n is a, c, g, or t
  misc_feature (325488)..(325587): n is a, c, g, or t
  misc_feature (327151)..(327250): n is a, c, g, or t
  misc_feature (332349)..(332448): n is a, c, g, or t
  misc_feature (332677)..(332776): n is a, c, g, or t
  misc_feature (336248)..(336347): n is a, c, g, or t
  misc_feature (338989)..(339088): n is a, c, g, or t
  misc_feature (339835)..(339840): n is a, c, g, or t
  misc_feature (340941)..(340948): n is a, c, g, or t
  misc_feature (341022)..(341123): n is a, c, g, or t
  misc_feature (342415)..(342514): n is a, c, g, or t
  misc_feature (343145)..(343246): n is a, c, g, or t
  misc_feature (346438)..(346551): n is a, c, g, or t
  misc_feature (346981)..(347088): n is a, c, g, or t
  misc_feature (348954)..(349053): n is a, c, g, or t
  misc_feature (349515)..(349614): n is a, c, g, or t
  misc_feature (351072)..(351171): n is a, c, g, or t
  misc_feature (353346)..(353445): n is a, c, g, or t
  misc_feature (357698)..(357797): n is a, c, g, or t
  misc_feature (359155)..(359170): n is a, c, g, or t
  misc_feature (361897)..(362081): n is a, c, g, or t
  misc_feature (362599)..(362751): n is a, c, g, or t
  misc_feature (362828)..(362841): n is a, c, g, or t
  misc_feature (364446)..(364947): n is a, c, g, or t
  misc_feature (365218)..(365658): n is a, c, g, or t
  misc_feature (370146)..(370620): n is a, c, g, or t
  misc_feature (371108)..(371373): n is a, c, g, or t
  misc_feature (371481)..(371997): n is a, c, g, or t
  misc_feature (372023)..(372229): n is a, c, g, or t
  misc_feature (375583)..(375682): n is a, c, g, or t
  misc_feature (376542)..(376585): n is a, c, g, or t
  misc_feature (384014)..(384113): n is a, c, g, or t
  misc_feature (386540)..(386639): n is a, c, g, or t
  misc_feature (388645)..(388745): n is a, c, g, or t
  misc_feature (389103)..(389202): n is a, c, g, or t
  misc_feature (390435)..(390534): n is a, c, g, or t
  misc_feature (390886)..(390985): n is a, c, g, or t
  misc_feature (391252)..(391351): n is a, c, g, or t
  misc_feature (391600)..(391699): n is a, c, g, or t
  misc_feature (394217)..(394316): n is a, c, g, or t
  misc_feature (395753)..(395845): n is a, c, g, or t
  misc_feature (396809)..(396918): n is a, c, g, or t
  misc_feature (400876)..(400975): n is a, c, g, or t
  misc_feature (401567)..(401591): n is a, c, g, or t
  misc_feature (406676)..(406721): n is a, c, g, or t
  misc_feature (408570)..(408669): n is a, c, g, or t
  misc_feature (409859)..(409958): n is a, c, g, or t
  misc_feature (410974)..(411073): n is a, c, g, or t
  misc_feature (411615)..(411757): n is a, c, g, or t
  misc_feature (412297)..(412396): n is a, c, g, or t
  misc_feature (413757)..(413856): n is a, c, g, or t
  misc_feature (417629)..(417669): n is a, c, g, or t
  misc_feature (425492)..(425591): n is a, c, g, or t
  misc_feature (427707)..(427806): n is a, c, g, or t
  misc_feature (428669)..(428768): n is a, c, g, or t
  misc_feature (429003)..(429102): n is a, c, g, or t
  misc_feature (430105)..(430204): n is a, c, g, or t
  misc_feature (431374)..(431473): n is a, c, g, or t
  misc_feature (432413)..(433149): n is a, c, g, or t
  misc_feature (434170)..(434269): n is a, c, g, or t
  misc_feature (439652)..(439664): n is a, c, g, or t
  misc_feature (440182)..(440251): n is a, c, g, or t
  misc_feature (442313)..(442417): n is a, c, g, or t
  misc_feature (445791)..(445890): n is a, c, g, or t
  misc_feature (447162)..(447261): n is a, c, g, or t
  misc_feature (452149)..(452248): n is a, c, g, or t
  misc_feature (454463)..(454562): n is a, c, g, or t
  misc_feature (455146)..(455245): n is a, c, g, or t
  misc_feature (458843)..(458942): n is a, c, g, or t
  misc_feature (463981)..(464018): n is a, c, g, or t
  misc_feature (470431)..(470530): n is a, c, g, or t
  misc_feature (471360)..(471585): n is a, c, g, or t
  misc_feature (474877)..(474879): n is a, c, g, or t
  misc_feature (476793)..(476894): n is a, c, g, or t
  misc_feature (478379)..(478478): n is a, c, g, or t
  misc_feature (480629)..(480728): n is a, c, g, or t
  misc_feature (484366)..(484465): n is a, c, g, or t
  misc_feature (488423)..(488531): n is a, c, g, or t
  misc_feature (491404)..(491503): n is a, c, g, or t
  misc_feature (499002)..(499101): n is a, c, g, or t
  misc_feature (501016)..(501115): n is a, c, g, or t
  misc_feature (504541)..(504640): n is a, c, g, or t
  misc_feature (505696)..(505912): n is a, c, g, or t
  misc_feature (507686)..(507785): n is a, c, g, or t
  misc_feature (508372)..(508471): n is a, c, g, or t
  misc_feature (508777)..(508876): n is a, c, g, or t
  misc_feature (508930)..(508940): n is a, c, g, or t
  misc_feature (509177)..(509196): n is a, c, g, or t
  misc_feature (509223)..(509244): n is a, c, g, or t
  misc_feature (509399)..(509498): n is a, c, g, or t
  misc_feature (510413)..(510512): n is a, c, g, or t
  misc_feature (511731)..(511742): n is a, c, g, or t
  misc_feature (514471)..(514570): n is a, c, g, or t
  misc_feature (518765)..(518864): n is a, c, g, or t
  misc_feature (519850)..(519949): n is a, c, g, or t
  misc_feature (520273)..(520373): n is a, c, g, or t
  misc_feature (524136)..(524298): n is a, c, g, or t
  misc_feature (526585)..(526611): n is a, c, g, or t
  misc_feature (527985)..(528084): n is a, c, g, or t
  misc_feature (528316)..(528415): n is a, c, g, or t
  misc_feature (534889)..(534988): n is a, c, g, or t
  misc_feature (535502)..(535601): n is a, c, g, or t
  misc_feature (537548)..(537647): n is a, c, g, or t
  misc_feature (539748)..(539847): n is a, c, g, or t
  misc_feature (540971)..(541070): n is a, c, g, or t
  misc_feature (541435)..(541575): n is a, c, g, or t
  misc_feature (542114)..(542213): n is a, c, g, or t
  misc_feature (542551)..(542650): n is a, c, g, or t
  misc_feature (544262)..(544363): n is a, c, g, or t
  misc_feature (544753)..(544853): n is a, c, g, or t
  misc_feature (545544)..(546160): n is a, c, g, or t
  misc_feature (547402)..(547645): n is a, c, g, or t
  misc_feature (547703)..(548032): n is a, c, g, or t
  misc_feature (548964)..(551401): n is a, c, g, or t
  misc_feature (552163)..(552262): n is a, c, g, or t
  misc_feature (552559)..(552658): n is a, c, g, or t
  misc_feature (553255)..(553354): n is a, c, g, or t
  misc_feature (553649)..(553748): n is a, c, g, or t
  misc_feature (557273)..(557372): n is a, c, g, or t
  misc_feature (563934)..(564275): n is a, c, g, or t
  misc_feature (567812)..(567911): n is a, c, g, or t
  misc_feature (572506)..(572605): n is a, c, g, or t
  misc_feature (572961)..(573060): n is a, c, g, or t
  misc_feature (574569)..(574668): n is a, c, g, or t
  misc_feature (574887)..(574986): n is a, c, g, or t
  misc_feature (576097)..(576196): n is a, c, g, or t
  misc_feature (576801)..(577103): n is a, c, g, or t
  misc_feature (577324)..(577423): n is a, c, g, or t
  misc_feature (577690)..(577789): n is a, c, g, or t
  misc_feature (579837)..(579936): n is a, c, g, or t
  misc_feature (580774)..(580873): n is a, c, g, or t
  misc_feature (580895)..(580895): n is a, c, g, or t
  misc_feature (581335)..(581435): n is a, c, g, or t
  misc_feature (583013)..(583120): n is a, c, g, or t
  misc_feature (586424)..(586523): n is a, c, g, or t
  misc_feature (586911)..(587010): n is a, c, g, or t
  misc_feature (587570)..(587687): n is a, c, g, or t
  misc_feature (587948)..(588047): n is a, c, g, or t
  misc_feature (589513)..(589612): n is a, c, g, or t
  misc_feature (593880)..(593979): n is a, c, g, or t
  misc_feature (595487)..(595586): n is a, c, g, or t
  misc_feature (597804)..(597903): n is a, c, g, or t
  misc_feature (599237)..(599336): n is a, c, g, or t
  misc_feature (601784)..(601883): n is a, c, g, or t
  misc_feature (602850)..(602949): n is a, c, g, or t
  misc_feature (603372)..(603392): n is a, c, g, or t
  misc_feature (605223)..(605322): n is a, c, g, or t
  misc_feature (605958)..(606068): n is a, c, g, or t
  misc_feature (606887)..(606986): n is a, c, g, or t
  misc_feature (608499)..(608649): n is a, c, g, or t
  misc_feature (609914)..(610013): n is a, c, g, or t
  misc_feature (615427)..(615526): n is a, c, g, or t
  misc_feature (617564)..(617676): n is a, c, g, or t
  misc_feature (617801)..(617816): n is a, c, g, or t
  misc_feature (622004)..(622105): n is a, c, g, or t
  misc_feature (622314)..(622413): n is a, c, g, or t
  misc_feature (623877)..(623976): n is a, c, g, or t
  misc_feature (630542)..(630783): n is a, c, g, or t
  misc_feature (630809)..(630881): n is a, c, g, or t
  misc_feature (630954)..(631083): n is a, c, g, or t
  misc_feature (632378)..(632477): n is a, c, g, or t
  misc_feature (636233)..(636332): n is a, c, g, or t
  misc_feature (638289)..(638388): n is a, c, g, or t
  misc_feature (639347)..(639446): n is a, c, g, or t
  misc_feature (640313)..(640412): n is a, c, g, or t
  misc_feature (641694)..(641793): n is a, c, g, or t
  misc_feature (645796)..(645895): n is a, c, g, or t
  misc_feature (649288)..(649387): n is a, c, g, or t
  misc_feature (649722)..(649821): n is a, c, g, or t
  misc_feature (651611)..(651718): n is a, c, g, or t
  misc_feature (653952)..(653958): n is a, c, g, or t
  misc_feature (660472)..(661405): n is a, c, g, or t
  misc_feature (661692)..(662129): n is a, c, g, or t
  misc_feature (662343)..(662689): n is a, c, g, or t
  misc_feature (662839)..(664008): n is a, c, g, or t
  misc_feature (664832)..(664931): n is a, c, g, or t
  misc_feature (666103)..(666204): n is a, c, g, or t
  misc_feature (667212)..(667233): n is a, c, g, or t
  misc_feature (669508)..(669607): n is a, c, g, or t
  misc_feature (669959)..(670058): n is a, c, g, or t
  misc_feature (670815)..(671796): n is a, c, g, or t
  misc_feature (674830)..(674929): n is a, c, g, or t
  misc_feature (675468)..(675567): n is a, c, g, or t
  misc_feature (677246)..(677345): n is a, c, g, or t
  misc_feature (677556)..(677659): n is a, c, g, or t
  misc_feature (681073)..(681172): n is a, c, g, or t
  misc_feature (687080)..(687179): n is a, c, g, or t
  misc_feature (688443)..(688559): n is a, c, g, or t
  misc_feature (689099)..(689108): n is a, c, g, or t
  misc_feature (689996)..(690095): n is a, c, g, or t
  misc_feature (691668)..(691767): n is a, c, g, or t
  misc_feature (692273)..(692372): n is a, c, g, or t
  misc_feature (693561)..(693660): n is a, c, g, or t
  misc_feature (695153)..(695252): n is a, c, g, or t
  misc_feature (696006)..(696106): n is a, c, g, or t
  misc_feature (700856)..(700955): n is a, c, g, or t
  misc_feature (703569)..(703668): n is a, c, g, or t
  misc_feature (704814)..(704913): n is a, c, g, or t
  misc_feature (705361)..(705460): n is a, c, g, or t
  misc_feature (705933)..(706034): n is a, c, g, or t
  misc_feature (709225)..(709324): n is a, c, g, or t
  misc_feature (709649)..(709748): n is a, c, g, or t
  misc_feature (710218)..(710317): n is a, c, g, or t
  misc_feature (711490)..(711589): n is a, c, g, or t
  misc_feature (711928)..(711949): n is a, c, g, or t
  misc_feature (713389)..(714250): n is a, c, g, or t
  misc_feature (714860)..(715913): n is a, c, g, or t
  misc_feature (716409)..(716508): n is a, c, g, or t
  misc_feature (717374)..(717381): n is a, c, g, or t
  misc_feature (719344)..(719466): n is a, c, g, or t
  misc_feature (723336)..(723435): n is a, c, g, or t
  misc_feature (725531)..(725630): n is a, c, g, or t
  misc_feature (727491)..(727590): n is a, c, g, or t
  misc_feature (732519)..(732618): n is a, c, g, or t
  misc_feature (734136)..(734238): n is a, c, g, or t
  misc_feature (736306)..(736405): n is a, c, g, or t
  misc_feature (736461)..(736464): n is a, c, g, or t
  misc_feature (736630)..(736734): n is a, c, g, or t
  misc_feature (737308)..(737407): n is a, c, g, or t
  misc_feature (738950)..(739049): n is a, c, g, or t
  misc_feature (742627)..(742718): n is a, c, g, or t
  misc_feature (743610)..(743709): n is a, c, g, or t
  misc_feature (746161)..(746260): n is a, c, g, or t
  misc_feature (747858)..(747957): n is a, c, g, or t
  misc_feature (750273)..(750372): n is a, c, g, or t
  misc_feature (751927)..(752026): n is a, c, g, or t
  misc_feature (752931)..(753030): n is a, c, g, or t
  misc_feature (765867)..(765966): n is a, c, g, or t
  misc_feature (766394)..(766493): n is a, c, g, or t
  misc_feature (769429)..(769529): n is a, c, g, or t
  misc_feature (769959)..(770058): n is a, c, g, or t
  misc_feature (771349)..(771448): n is a, c, g, or t
  misc_feature (771868)..(771886): n is a, c, g, or t
  misc_feature (771963)..(772062): n is a, c, g, or t
  misc_feature (775283)..(775425): n is a, c, g, or t
  misc_feature (775524)..(775554): n is a, c, g, or t
  misc_feature (775609)..(776155): n is a, c, g, or t
  misc_feature (776748)..(776748): n is a, c, g, or t
  misc_feature (777164)..(777176): n is a, c, g, or t
  misc_feature (780667)..(780766): n is a, c, g, or t
  misc_feature (785684)..(785783): n is a, c, g, or t
  misc_feature (786645)..(786744): n is a, c, g, or t
  misc_feature (788475)..(788574): n is a, c, g, or t
  misc_feature (789387)..(789486): n is a, c, g, or t
  misc_feature (790514)..(790613): n is a, c, g, or t
  misc_feature (792183)..(792189): n is a, c, g, or t
  misc_feature (793872)..(793971): n is a, c, g, or t
  misc_feature (794860)..(794959): n is a, c, g, or t
  misc_feature (795188)..(795298): n is a, c, g, or t
  misc_feature (795607)..(795706): n is a, c, g, or t
  misc_feature (796098)..(796197): n is a, c, g, or t
  misc_feature (796750)..(796874): n is a, c, g, or t
  misc_feature (796967)..(796981): n is a, c, g, or t
  misc_feature (797060)..(797210): n is a, c, g, or t
  misc_feature (797474)..(797578): n is a, c, g, or t
  misc_feature (798672)..(798771): n is a, c, g, or t
  misc_feature (799618)..(799625): n is a, c, g, or t
  misc_feature (802529)..(802628): n is a, c, g, or t
  misc_feature (804793)..(804901): n is a, c, g, or t
  misc_feature (805814)..(805880): n is a, c, g, or t
  misc_feature (805907)..(806024): n is a, c, g, or t
  misc_feature (806054)..(806092): n is a, c, g, or t
  misc_feature (806144)..(806167): n is a, c, g, or t
  misc_feature (806209)..(806460): n is a, c, g, or t
  misc_feature (808787)..(808886): n is a, c, g, or t
  misc_feature (809502)..(809706): n is a, c, g, or t
  misc_feature (811148)..(811247): n is a, c, g, or t
  misc_feature (811983)..(812083): n is a, c, g, or t
  misc_feature (815553)..(815652): n is a, c, g, or t
  misc_feature (815872)..(815994): n is a, c, g, or t
  misc_feature (818326)..(818426): n is a, c, g, or t
  misc_feature (819071)..(819170): n is a, c, g, or t
  misc_feature (823168)..(823267): n is a, c, g, or t
  misc_feature (827547)..(827565): n is a, c, g, or t
  misc_feature (828718)..(828817): n is a, c, g, or t
  misc_feature (829835)..(829944): n is a, c, g, or t
  misc_feature (830562)..(830661): n is a, c, g, or t
  misc_feature (831726)..(831829): n is a, c, g, or t
  misc_feature (836938)..(837057): n is a, c, g, or t
  misc_feature (837266)..(837293): n is a, c, g, or t
  misc_feature (838446)..(838545): n is a, c, g, or t
  misc_feature (839501)..(840005): n is a, c, g, or t
  misc_feature (840126)..(840129): n is a, c, g, or t
  misc_feature (840329)..(840428): n is a, c, g, or t
  misc_feature (841563)..(841663): n is a, c, g, or t
  misc_feature (849213)..(849243): n is a, c, g, or t
  misc_feature (850029)..(850038): n is a, c, g, or t
  misc_feature (850201)..(850300): n is a, c, g, or t
  misc_feature (850566)..(850665): n is a, c, g, or t
  misc_feature (857198)..(857297): n is a, c, g, or t
  misc_feature (859621)..(859720): n is a, c, g, or t
  misc_feature (864587)..(864686): n is a, c, g, or t
  misc_feature (865733)..(865833): n is a, c, g, or t
  misc_feature (871877)..(871976): n is a, c, g, or t
  misc_feature (872208)..(872308): n is a, c, g, or t
  misc_feature (872570)..(872669): n is a, c, g, or t
  misc_feature (875453)..(875552): n is a, c, g, or t
  misc_feature (884054)..(884153): n is a, c, g, or t
  misc_feature (884531)..(884630): n is a, c, g, or t
  misc_feature (884898)..(884997): n is a, c, g, or t
  misc_feature (894636)..(894735): n is a, c, g, or t
  misc_feature (897797)..(897896): n is a, c, g, or t
  misc_feature (898308)..(898407): n is a, c, g, or t
  misc_feature (899286)..(899385): n is a, c, g, or t
  misc_feature (900435)..(900439): n is a, c, g, or t
  misc_feature (902605)..(902707): n is a, c, g, or t
  misc_feature (905673)..(905772): n is a, c, g, or t
  misc_feature (906259)..(906361): n is a, c, g, or t
  misc_feature (907411)..(908236): n is a, c, g, or t
  misc_feature (909595)..(909704): n is a, c, g, or t
  misc_feature (910785)..(910876): n is a, c, g, or t
  misc_feature (911135)..(911273): n is a, c, g, or t
  misc_feature (911544)..(911643): n is a, c, g, or t
  misc_feature (913405)..(913504): n is a, c, g, or t
  misc_feature (916605)..(916706): n is a, c, g, or t
  misc_feature (921133)..(921233): n is a, c, g, or t
  misc_feature (923399)..(923408): n is a, c, g, or t
  misc_feature (924230)..(924329): n is a, c, g, or t
  misc_feature (927024)..(927123): n is a, c, g, or t
  misc_feature (927774)..(927873): n is a, c, g, or t
  misc_feature (928901)..(929000): n is a, c, g, or t
  misc_feature (929439)..(929461): n is a, c, g, or t
  misc_feature (929579)..(929685): n is a, c, g, or t
  misc_feature (931118)..(931217): n is a, c, g, or t
  misc_feature (931502)..(931601): n is a, c, g, or t
  misc_feature (936696)..(936795): n is a, c, g, or t
  misc_feature (940815)..(940914): n is a, c, g, or t
  misc_feature (941162)..(941261): n is a, c, g, or t
  misc_feature (943369)..(943476): n is a, c, g, or t
  misc_feature (944300)..(944399): n is a, c, g, or t
  misc_feature (948694)..(948793): n is a, c, g, or t
  misc_feature (949123)..(949222): n is a, c, g, or t
  misc_feature (949613)..(949712): n is a, c, g, or t
  misc_feature (951846)..(952559): n is a, c, g, or t
  misc_feature (952638)..(952641): n is a, c, g, or t
  misc_feature (955534)..(955633): n is a, c, g, or t
  misc_feature (956029)..(956128): n is a, c, g, or t
  misc_feature (957391)..(957490): n is a, c, g, or t
  misc_feature (964108)..(964222): n is a, c, g, or t
  misc_feature (967088)..(967200): n is a, c, g, or t
  misc_feature (967948)..(968047): n is a, c, g, or t
  misc_feature (969501)..(969600): n is a, c, g, or t
  misc_feature (972148)..(972247): n is a, c, g, or t
  misc_feature (973191)..(973295): n is a, c, g, or t
  misc_feature (973630)..(973729): n is a, c, g, or t
  misc_feature (974294)..(974393): n is a, c, g, or t
  misc_feature (974913)..(975012): n is a, c, g, or t
  misc_feature (976130)..(976229): n is a, c, g, or t
  misc_feature (978378)..(978513): n is a, c, g, or t
  misc_feature (978864)..(978963): n is a, c, g, or t
  misc_feature (984086)..(984185): n is a, c, g, or t
  misc_feature (984684)..(985186): n is a, c, g, or t
  misc_feature (985623)..(985722): n is a, c, g, or t
  misc_feature (986847)..(986946): n is a, c, g, or t
  misc_feature (989351)..(989451): n is a, c, g, or t
  misc_feature (992545)..(992644): n is a, c, g, or t
  misc_feature (993937)..(994036): n is a, c, g, or t
  misc_feature (997536)..(997635): n is a, c, g, or t
  misc_feature (1001502)..(1001601): n is a, c, g, or t
  misc_feature (1001904)..(1002003): n is a, c, g, or t
  misc_feature (1002332)..(1002431): n is a, c, g, or t
  misc_feature (1006266)..(1006367): n is a, c, g, or t
  misc_feature (1008772)..(1008871): n is a, c, g, or t
  misc_feature (1012354)..(1012453): n is a, c, g, or t
  misc_feature (1012848)..(1012947): n is a, c, g, or t
  misc_feature (1013235)..(1013334): n is a, c, g, or t
  misc_feature (1014028)..(1014127): n is a, c, g, or t
  misc_feature (1015741)..(1015744): n is a, c, g, or t
  misc_feature (1016359)..(1016463): n is a, c, g, or t
  misc_feature (1020262)..(1020361): n is a, c, g, or t
  misc_feature (1020894)..(1020993): n is a, c, g, or t
  misc_feature (1022416)..(1022515): n is a, c, g, or t
  misc_feature (1022882)..(1022981): n is a, c, g, or t
  misc_feature (1023408)..(1023536): n is a, c, g, or t
  misc_feature (1023727)..(1024055): n is a, c, g, or t
  misc_feature (1024985)..(1025084): n is a, c, g, or t
  misc_feature (1025350)..(1025449): n is a, c, g, or t
  misc_feature (1025715)..(1025715): n is a, c, g, or t
  misc_feature (1025741)..(1025840): n is a, c, g, or t
  misc_feature (1026664)..(1026763): n is a, c, g, or t
  misc_feature (1027036)..(1027135): n is a, c, g, or t
  misc_feature (1028144)..(1028243): n is a, c, g, or t
  misc_feature (1034549)..(1034648): n is a, c, g, or t
  misc_feature (1035908)..(1036007): n is a, c, g, or t
  misc_feature (1037164)..(1037263): n is a, c, g, or t
  misc_feature (1038730)..(1038843): n is a, c, g, or t
  misc_feature (1039947)..(1040047): n is a, c, g, or t
  misc_feature (1040432)..(1040531): n is a, c, g, or t
  misc_feature (1041788)..(1041887): n is a, c, g, or t
  misc_feature (1050437)..(1050536): n is a, c, g, or t
  misc_feature (1050943)..(1051042): n is a, c, g, or t
  misc_feature (1052889)..(1052988): n is a, c, g, or t
  misc_feature (1054083)..(1054182): n is a, c, g, or t
  misc_feature (1055684)..(1055783): n is a, c, g, or t
  misc_feature (1059036)..(1059083): n is a, c, g, or t
  misc_feature (1060091)..(1060190): n is a, c, g, or t
  misc_feature (1060270)..(1060307): n is a, c, g, or t
  misc_feature (1060704)..(1060803): n is a, c, g, or t
  misc_feature (1061288)..(1061387): n is a, c, g, or t
  misc_feature (1062570)..(1062669): n is a, c, g, or t
  misc_feature (1063265)..(1063364): n is a, c, g, or t
  misc_feature (1065587)..(1065687): n is a, c, g, or t
  misc_feature (1065899)..(1066002): n is a, c, g, or t
  misc_feature (1071374)..(1071473): n is a, c, g, or t
  misc_feature (1072287)..(1072389): n is a, c, g, or t
  misc_feature (1072690)..(1072789): n is a, c, g, or t
  misc_feature (1075843)..(1075944): n is a, c, g, or t
  misc_feature (1076207)..(1076308): n is a, c, g, or t
  misc_feature (1079724)..(1079823): n is a, c, g, or t
  misc_feature (1081173)..(1081277): n is a, c, g, or t
  misc_feature (1081852)..(1081951): n is a, c, g, or t
  misc_feature (1082432)..(1082531): n is a, c, g, or t
  misc_feature (1083291)..(1083390): n is a, c, g, or t
  misc_feature (1088330)..(1088429): n is a, c, g, or t
  misc_feature (1089329)..(1089428): n is a, c, g, or t
  misc_feature (1090900)..(1090999): n is a, c, g, or t
  misc_feature (1091458)..(1091557): n is a, c, g, or t
  misc_feature (1092079)..(1092178): n is a, c, g, or t
  misc_feature (1093391)..(1093503): n is a, c, g, or t
  misc_feature (1095608)..(1095707): n is a, c, g, or t
  misc_feature (1102835)..(1102934): n is a, c, g, or t
  misc_feature (1103370)..(1103469): n is a, c, g, or t
  misc_feature (1105813)..(1105912): n is a, c, g, or t
  misc_feature (1107883)..(1107989): n is a, c, g, or t
  misc_feature (1109152)..(1109251): n is a, c, g, or t
  misc_feature (1109501)..(1109600): n is a, c, g, or t
  misc_feature (1115799)..(1116018): n is a, c, g, or t
  misc_feature (1116271)..(1116373): n is a, c, g, or t
  misc_feature (1118858)..(1118957): n is a, c, g, or t
  misc_feature (1119920)..(1120019): n is a, c, g, or t
  misc_feature (1123201)..(1123218): n is a, c, g, or t
  misc_feature (1123255)..(1123282): n is a, c, g, or t
  misc_feature (1123421)..(1123467): n is a, c, g, or t
  misc_feature (1124658)..(1124697): n is a, c, g, or t
  misc_feature (1125960)..(1126059): n is a, c, g, or t
  misc_feature (1128537)..(1128636): n is a, c, g, or t
  misc_feature (1135500)..(1135599): n is a, c, g, or t
  misc_feature (1140768)..(1140873): n is a, c, g, or t
  misc_feature (1141406)..(1141505): n is a, c, g, or t
  misc_feature (1144852)..(1144951): n is a, c, g, or t
  misc_feature (1145965)..(1146064): n is a, c, g, or t
  misc_feature (1151433)..(1151532): n is a, c, g, or t
  misc_feature (1157946)..(1158045): n is a, c, g, or t
  misc_feature (1167611)..(1167710): n is a, c, g, or t
  misc_feature (1168783)..(1168882): n is a, c, g, or t
  misc_feature (1169714)..(1169719): n is a, c, g, or t
  misc_feature (1171109)..(1171214): n is a, c, g, or t
  misc_feature (1174273)..(1174299): n is a, c, g, or t
  misc_feature (1178318)..(1178417): n is a, c, g, or t
  misc_feature (1178709)..(1179411): n is a, c, g, or t
  misc_feature (1179777)..(1179876): n is a, c, g, or t
  misc_feature (1180402)..(1180501): n is a, c, g, or t
  misc_feature (1182501)..(1182603): n is a, c, g, or t
  misc_feature (1185068)..(1185167): n is a, c, g, or t
  misc_feature (1186132)..(1186310): n is a, c, g, or t
  misc_feature (1186810)..(1187793): n is a, c, g, or t
  misc_feature (1188673)..(1188688): n is a, c, g, or t
  misc_feature (1190484)..(1190504): n is a, c, g, or t
  misc_feature (1191253)..(1191352): n is a, c, g, or t
  misc_feature (1193898)..(1193997): n is a, c, g, or t
  misc_feature (1194340)..(1194439): n is a, c, g, or t
  misc_feature (1194762)..(1194861): n is a, c, g, or t
  misc_feature (1195063)..(1195162): n is a, c, g, or t
  misc_feature (1195722)..(1195821): n is a, c, g, or t
  misc_feature (1196022)..(1196121): n is a, c, g, or t
  misc_feature (1203176)..(1203275): n is a, c, g, or t
  misc_feature (1203972)..(1204071): n is a, c, g, or t
  misc_feature (1205099)..(1205238): n is a, c, g, or t
  misc_feature (1209889)..(1209988): n is a, c, g, or t
  misc_feature (1210759)..(1210858): n is a, c, g, or t
  misc_feature (1211807)..(1211906): n is a, c, g, or t
  misc_feature (1212996)..(1213095): n is a, c, g, or t
  misc_feature (1217153)..(1217252): n is a, c, g, or t
  misc_feature (1219835)..(1222692): n is a, c, g, or t
  misc_feature (1224146)..(1224245): n is a, c, g, or t
  misc_feature (1225613)..(1225616): n is a, c, g, or t
  misc_feature (1227603)..(1227702): n is a, c, g, or t
  misc_feature (1235519)..(1235618): n is a, c, g, or t
  misc_feature (1236750)..(1236849): n is a, c, g, or t
  misc_feature (1239381)..(1239480): n is a, c, g, or t
  misc_feature (1242912)..(1243016): n is a, c, g, or t
  misc_feature (1244018)..(1244117): n is a, c, g, or t
  misc_feature (1247814)..(1247913): n is a, c, g, or t
  misc_feature (1248079)..(1248080): n is a, c, g, or t
  misc_feature (1248329)..(1248428): n is a, c, g, or t
  misc_feature (1249029)..(1249138): n is a, c, g, or t
  misc_feature (1249489)..(1249588): n is a, c, g, or t
  misc_feature (1250643)..(1250742): n is a, c, g, or t
  misc_feature (1251005)..(1251046): n is a, c, g, or t
  misc_feature (1252262)..(1252361): n is a, c, g, or t
  misc_feature (1252628)..(1252727): n is a, c, g, or t
  misc_feature (1253475)..(1253574): n is a, c, g, or t
  misc_feature (1255726)..(1255830): n is a, c, g, or t
  misc_feature (1256485)..(1256589): n is a, c, g, or t
  misc_feature (1257847)..(1257946): n is a, c, g, or t
  misc_feature (1259142)..(1259242): n is a, c, g, or t
  misc_feature (1259623)..(1259722): n is a, c, g, or t
  misc_feature (1264142)..(1264241): n is a, c, g, or t
  misc_feature (1265110)..(1265209): n is a, c, g, or t
  misc_feature (1265474)..(1265574): n is a, c, g, or t
  misc_feature (1265966)..(1266065): n is a, c, g, or t
  misc_feature (1268235)..(1268334): n is a, c, g, or t
  misc_feature (1271088)..(1271187): n is a, c, g, or t
  misc_feature (1274181)..(1274280): n is a, c, g, or t
  misc_feature (1275410)..(1275511): n is a, c, g, or t
  misc_feature (1277766)..(1277766): n is a, c, g, or t
  misc_feature (1280870)..(1280969): n is a, c, g, or t
  misc_feature (1281554)..(1281658): n is a, c, g, or t
  misc_feature (1282019)..(1282118): n is a, c, g, or t
  misc_feature (1282962)..(1283061): n is a, c, g, or t
  misc_feature (1284414)..(1284513): n is a, c, g, or t
  misc_feature (1284872)..(1284971): n is a, c, g, or t
  misc_feature (1286930)..(1287029): n is a, c, g, or t
  misc_feature (1287549)..(1287648): n is a, c, g, or t
  misc_feature (1289107)..(1289206): n is a, c, g, or t
  misc_feature (1290948)..(1291047): n is a, c, g, or t
  misc_feature (1291328)..(1291427): n is a, c, g, or t
  misc_feature (1292569)..(1292668): n is a, c, g, or t
  misc_feature (1294899)..(1294999): n is a, c, g, or t
  misc_feature (1296165)..(1296264): n is a, c, g, or t
  misc_feature (1297355)..(1297454): n is a, c, g, or t
  misc_feature (1299532)..(1299631): n is a, c, g, or t
  misc_feature (1300884)..(1300983): n is a, c, g, or t
  misc_feature (1301832)..(1301934): n is a, c, g, or t
  misc_feature (1306357)..(1306456): n is a, c, g, or t
  misc_feature (1307222)..(1307321): n is a, c, g, or t
  misc_feature (1307827)..(1307926): n is a, c, g, or t
  misc_feature (1310179)..(1310278): n is a, c, g, or t
  misc_feature (1311486)..(1311585): n is a, c, g, or t
  misc_feature (1312507)..(1312606): n is a, c, g, or t
  misc_feature (1314629)..(1314736): n is a, c, g, or t
  misc_feature (1317309)..(1317408): n is a, c, g, or t
  misc_feature (1318168)..(1318267): n is a, c, g, or t
  misc_feature (1318621)..(1318721): n is a, c, g, or t
  misc_feature (1320780)..(1320879): n is a, c, g, or t
  misc_feature (1324979)..(1325078): n is a, c, g, or t
  misc_feature (1325488)..(1325587): n is a, c, g, or t
  misc_feature (1327217)..(1327316): n is a, c, g, or t
  misc_feature (1330378)..(1330479): n is a, c, g, or t
  misc_feature (1331581)..(1331680): n is a, c, g, or t
  misc_feature (1337428)..(1337527): n is a, c, g, or t
  misc_feature (1340368)..(1340467): n is a, c, g, or t
  misc_feature (1346065)..(1346164): n is a, c, g, or t
  misc_feature (1349414)..(1349513): n is a, c, g, or t
  misc_feature (1350371)..(1350470): n is a, c, g, or t
  misc_feature (1354400)..(1354499): n is a, c, g, or t
  misc_feature (1355511)..(1355656): n is a, c, g, or t
  misc_feature (1357886)..(1357986): n is a, c, g, or t
  misc_feature (1358336)..(1358435): n is a, c, g, or t
  misc_feature (1359103)..(1359202): n is a, c, g, or t
  misc_feature (1359784)..(1359884): n is a, c, g, or t
  misc_feature (1360124)..(1360223): n is a, c, g, or t
  misc_feature (1361839)..(1361938): n is a, c, g, or t
  misc_feature (1364146)..(1364245): n is a, c, g, or t
  misc_feature (1365694)..(1365793): n is a, c, g, or t
  misc_feature (1367801)..(1367900): n is a, c, g, or t
  misc_feature (1369636)..(1369735): n is a, c, g, or t
  misc_feature (1369954)..(1370053): n is a, c, g, or t
  misc_feature (1371153)..(1371265): n is a, c, g, or t
  misc_feature (1371784)..(1371883): n is a, c, g, or t
  misc_feature (1372472)..(1372571): n is a, c, g, or t
  misc_feature (1374818)..(1374918): n is a, c, g, or t
  misc_feature (1375298)..(1375308): n is a, c, g, or t
  misc_feature (1375918)..(1375975): n is a, c, g, or t
  misc_feature (1378831)..(1378930): n is a, c, g, or t
  misc_feature (1380159)..(1380261): n is a, c, g, or t
  misc_feature (1381759)..(1381858): n is a, c, g, or t
  misc_feature (1382086)..(1382185): n is a, c, g, or t
  misc_feature (1385750)..(1385852): n is a, c, g, or t
  misc_feature (1386504)..(1386524): n is a, c, g, or t
  misc_feature (1386606)..(1386624): n is a, c, g, or t
  misc_feature (1386699)..(1386735): n is a, c, g, or t
  misc_feature (1386930)..(1387015): n is a, c, g, or t
  misc_feature (1387306)..(1387405): n is a, c, g, or t
  misc_feature (1388087)..(1388147): n is a, c, g, or t
  misc_feature (1388171)..(1388227): n is a, c, g, or t
  misc_feature (1388270)..(1388394): n is a, c, g, or t
  misc_feature (1388600)..(1388710): n is a, c, g, or t
  misc_feature (1388951)..(1389050): n is a, c, g, or t
  misc_feature (1391390)..(1391489): n is a, c, g, or t
  misc_feature (1392986)..(1393090): n is a, c, g, or t
  misc_feature (1394017)..(1394038): n is a, c, g, or t
  misc_feature (1394089)..(1394140): n is a, c, g, or t
  misc_feature (1397427)..(1397526): n is a, c, g, or t
  misc_feature (1397842)..(1397941): n is a, c, g, or t
  misc_feature (1398905)..(1399004): n is a, c, g, or t
  misc_feature (1400568)..(1400667): n is a, c, g, or t
  misc_feature (1402247)..(1402346): n is a, c, g, or t
  misc_feature (1402597)..(1402696): n is a, c, g, or t
  misc_feature (1407659)..(1407758): n is a, c, g, or t
  misc_feature (1408739)..(1408838): n is a, c, g, or t
  misc_feature (1410212)..(1410311): n is a, c, g, or t
  misc_feature (1410768)..(1410867): n is a, c, g, or t
  misc_feature (1411759)..(1411858): n is a, c, g, or t
  misc_feature (1412667)..(1412766): n is a, c, g, or t
  misc_feature (1413618)..(1413717): n is a, c, g, or t
  misc_feature (1415236)..(1415335): n is a, c, g, or t
  misc_feature (1417211)..(1417225): n is a, c, g, or t
  misc_feature (1418517)..(1418616): n is a, c, g, or t
  misc_feature (1419824)..(1419923): n is a, c, g, or t
  misc_feature (1420554)..(1420567): n is a, c, g, or t
  misc_feature (1420769)..(1420872): n is a, c, g, or t
  misc_feature (1424092)..(1424191): n is a, c, g, or t
  misc_feature (1428193)..(1428292): n is a, c, g, or t
  misc_feature (1428467)..(1428494): n is a, c, g, or t
  misc_feature (1428903)..(1428927): n is a, c, g, or t
  misc_feature (1428977)..(1428986): n is a, c, g, or t
  misc_feature (1433816)..(1433915): n is a, c, g, or t
  misc_feature (1437898)..(1437997): n is a, c, g, or t
  misc_feature (1440192)..(1440291): n is a, c, g, or t
  misc_feature (1443543)..(1443642): n is a, c, g, or t
  misc_feature (1448443)..(1448542): n is a, c, g, or t
  misc_feature (1450023)..(1450122): n is a, c, g, or t
  misc_feature (1451000)..(1451099): n is a, c, g, or t
  misc_feature (1454844)..(1454943): n is a, c, g, or t
  misc_feature (1459462)..(1459569): n is a, c, g, or t
  misc_feature (1459833)..(1459932): n is a, c, g, or t
  misc_feature (1460137)..(1460216): n is a, c, g, or t
  misc_feature (1460272)..(1460320): n is a, c, g, or t
  misc_feature (1460351)..(1460450): n is a, c, g, or t
  misc_feature (1464273)..(1464372): n is a, c, g, or t
  misc_feature (1464725)..(1464825): n is a, c, g, or t
  misc_feature (1465843)..(1465942): n is a, c, g, or t
  misc_feature (1467896)..(1467995): n is a, c, g, or t
  misc_feature (1468798)..(1468911): n is a, c, g, or t
  misc_feature (1470189)..(1470288): n is a, c, g, or t
  misc_feature (1470923)..(1471023): n is a, c, g, or t
  misc_feature (1471095)..(1471397): n is a, c, g, or t
  misc_feature (1471663)..(1471764): n is a, c, g, or t
  misc_feature (1474369)..(1474468): n is a, c, g, or t
  misc_feature (1475018)..(1475117): n is a, c, g, or t
  misc_feature (1475645)..(1475744): n is a, c, g, or t
  misc_feature (1478669)..(1478849): n is a, c, g, or t
  misc_feature (1480767)..(1480892): n is a, c, g, or t
  misc_feature (1482523)..(1482622): n is a, c, g, or t
  misc_feature (1484766)..(1484865): n is a, c, g, or t
  misc_feature (1485903)..(1486002): n is a, c, g, or t
  misc_feature (1486292)..(1486391): n is a, c, g, or t
  misc_feature (1487798)..(1487805): n is a, c, g, or t
  misc_feature (1490963)..(1491062): n is a, c, g, or t
  misc_feature (1491336)..(1491435): n is a, c, g, or t
  misc_feature (1492172)..(1492272): n is a, c, g, or t
  misc_feature (1492767)..(1492866): n is a, c, g, or t
  misc_feature (1493491)..(1493597): n is a, c, g, or t
  misc_feature (1500236)..(1500335): n is a, c, g, or t
  misc_feature (1500743)..(1500842): n is a, c, g, or t
  misc_feature (1502588)..(1502687): n is a, c, g, or t
  misc_feature (1503111)..(1503216): n is a, c, g, or t
  misc_feature (1505097)..(1505155): n is a, c, g, or t
  misc_feature (1505807)..(1505906): n is a, c, g, or t
  misc_feature (1507962)..(1508061): n is a, c, g, or t
  misc_feature (1508597)..(1508708): n is a, c, g, or t
  misc_feature (1511127)..(1511227): n is a, c, g, or t
  misc_feature (1511979)..(1512078): n is a, c, g, or t
  misc_feature (1512742)..(1512841): n is a, c, g, or t
  misc_feature (1513335)..(1513434): n is a, c, g, or t
  misc_feature (1515633)..(1515732): n is a, c, g, or t
  misc_feature (1516112)..(1516134): n is a, c, g, or t
  misc_feature (1516344)..(1516374): n is a, c, g, or t
  misc_feature (1518551)..(1518650): n is a, c, g, or t
  misc_feature (1522790)..(1522889): n is a, c, g, or t
  misc_feature (1523171)..(1523278): n is a, c, g, or t
  misc_feature (1523912)..(1524011): n is a, c, g, or t
  misc_feature (1527240)..(1527339): n is a, c, g, or t
  misc_feature (1527561)..(1527660): n is a, c, g, or t
  misc_feature (1530136)..(1530235): n is a, c, g, or t
  misc_feature (1531777)..(1531879): n is a, c, g, or t
  misc_feature (1533030)..(1533129): n is a, c, g, or t
  misc_feature (1534192)..(1534291): n is a, c, g, or t
  misc_feature (1534462)..(1534470): n is a, c, g, or t
  misc_feature (1534520)..(1534619): n is a, c, g, or t
  misc_feature (1535076)..(1535175): n is a, c, g, or t
  misc_feature (1535803)..(1535902): n is a, c, g, or t
  misc_feature (1536850)..(1536949): n is a, c, g, or t
  misc_feature (1538594)..(1538844): n is a, c, g, or t
  misc_feature (1539480)..(1539624): n is a, c, g, or t
  misc_feature (1542421)..(1542520): n is a, c, g, or t
  misc_feature (1544195)..(1544294): n is a, c, g, or t
  misc_feature (1544838)..(1544937): n is a, c, g, or t
  misc_feature (1549328)..(1549427): n is a, c, g, or t
  misc_feature (1551082)..(1551182): n is a, c, g, or t
  misc_feature (1566036)..(1566276): n is a, c, g, or t
  misc_feature (1566341)..(1566440): n is a, c, g, or t
  misc_feature (1567092)..(1567191): n is a, c, g, or t
  misc_feature (1568217)..(1568222): n is a, c, g, or t
  misc_feature (1568274)..(1568391): n is a, c, g, or t
  misc_feature (1569464)..(1569563): n is a, c, g, or t
  misc_feature (1570521)..(1570620): n is a, c, g, or t
  misc_feature (1571068)..(1571169): n is a, c, g, or t
  misc_feature (1571528)..(1571630): n is a, c, g, or t
  misc_feature (1571953)..(1572052): n is a, c, g, or t
  misc_feature (1573551)..(1573650): n is a, c, g, or t
  misc_feature (1573937)..(1574036): n is a, c, g, or t
  misc_feature (1575329)..(1575431): n is a, c, g, or t
  misc_feature (1576167)..(1576270): n is a, c, g, or t
  misc_feature (1577091)..(1577190): n is a, c, g, or t
  misc_feature (1578892)..(1582678): n is a, c, g, or t
  misc_feature (1583407)..(1583506): n is a, c, g, or t
  misc_feature (1584029)..(1584128): n is a, c, g, or t
  misc_feature (1584426)..(1584528): n is a, c, g, or t
  misc_feature (1588310)..(1588409): n is a, c, g, or t
  misc_feature (1591706)..(1591805): n is a, c, g, or t
  misc_feature (1592534)..(1592635): n is a, c, g, or t
  misc_feature (1597930)..(1598029): n is a, c, g, or t
  misc_feature (1598641)..(1598740): n is a, c, g, or t
  misc_feature (1599063)..(1599165): n is a, c, g, or t
  misc_feature (1602011)..(1602110): n is a, c, g, or t
  misc_feature (1602732)..(1602863): n is a, c, g, or t
  misc_feature (1603062)..(1603161): n is a, c, g, or t
  misc_feature (1605379)..(1605478): n is a, c, g, or t
  misc_feature (1606180)..(1606279): n is a, c, g, or t
  misc_feature (1610917)..(1611016): n is a, c, g, or t
  misc_feature (1612145)..(1612244): n is a, c, g, or t
  misc_feature (1613971)..(1614070): n is a, c, g, or t
  misc_feature (1615471)..(1615570): n is a, c, g, or t
  misc_feature (1621090)..(1621189): n is a, c, g, or t
  misc_feature (1621424)..(1621523): n is a, c, g, or t
  misc_feature (1622969)..(1622972): n is a, c, g, or t
  misc_feature (1625180)..(1625279): n is a, c, g, or t
  misc_feature (1632288)..(1632404): n is a, c, g, or t
  misc_feature (1632794)..(1632893): n is a, c, g, or t
  misc_feature (1633153)..(1633255): n is a, c, g, or t
  misc_feature (1634446)..(1634450): n is a, c, g, or t
  misc_feature (1635774)..(1635873): n is a, c, g, or t
  misc_feature (1637263)..(1637363): n is a, c, g, or t
  misc_feature (1639240)..(1639255): n is a, c, g, or t
  misc_feature (1645686)..(1645785): n is a, c, g, or t
  misc_feature (1646014)..(1646113): n is a, c, g, or t
  misc_feature (1646388)..(1646487): n is a, c, g, or t
  misc_feature (1648481)..(1648580): n is a, c, g, or t
  misc_feature (1649085)..(1649184): n is a, c, g, or t
  misc_feature (1650121)..(1650220): n is a, c, g, or t
  misc_feature (1651126)..(1651225): n is a, c, g, or t
  misc_feature (1652396)..(1652496): n is a, c, g, or t
  misc_feature (1655303)..(1655402): n is a, c, g, or t
  misc_feature (1657307)..(1657406): n is a, c, g, or t
  misc_feature (1657738)..(1657831): n is a, c, g, or t
  misc_feature (1661812)..(1661906): n is a, c, g, or t
  misc_feature (1671492)..(1671522): n is a, c, g, or t
  misc_feature (1671580)..(1671597): n is a, c, g, or t
  misc_feature (1672524)..(1673364): n is a, c, g, or t
  misc_feature (1673718)..(1673851): n is a, c, g, or t
  misc_feature (1674472)..(1675800): n is a, c, g, or t
  misc_feature (1679520)..(1679619): n is a, c, g, or t
  misc_feature (1680307)..(1680406): n is a, c, g, or t
  misc_feature (1683998)..(1684097): n is a, c, g, or t
  misc_feature (1687831)..(1687930): n is a, c, g, or t
  misc_feature (1690729)..(1690828): n is a, c, g, or t
  misc_feature (1691447)..(1691480): n is a, c, g, or t
  misc_feature (1691786)..(1691885): n is a, c, g, or t
  misc_feature (1693455)..(1693562): n is a, c, g, or t
  misc_feature (1694855)..(1694954): n is a, c, g, or t
  misc_feature (1695694)..(1695793): n is a, c, g, or t
  misc_feature (1700526)..(1700625): n is a, c, g, or t
  misc_feature (1701037)..(1701136): n is a, c, g, or t
  misc_feature (1704706)..(1704812): n is a, c, g, or t
  misc_feature (1705736)..(1705737): n is a, c, g, or t
  misc_feature (1708020)..(1708119): n is a, c, g, or t
  misc_feature (1709447)..(1709547): n is a, c, g, or t
  misc_feature (1709751)..(1709850): n is a, c, g, or t
  misc_feature (1710675)..(1710774): n is a, c, g, or t
  misc_feature (1711081)..(1711180): n is a, c, g, or t
  misc_feature (1711527)..(1711626): n is a, c, g, or t
  misc_feature (1711865)..(1711964): n is a, c, g, or t
  misc_feature (1713364)..(1713463): n is a, c, g, or t
  misc_feature (1718066)..(1718165): n is a, c, g, or t
  misc_feature (1719828)..(1719931): n is a, c, g, or t
  misc_feature (1720961)..(1720967): n is a, c, g, or t
  misc_feature (1721257)..(1721359): n is a, c, g, or t
  misc_feature (1721482)..(1721491): n is a, c, g, or t
  misc_feature (1721608)..(1721638): n is a, c, g, or t
  misc_feature (1721749)..(1721764): n is a, c, g, or t
  misc_feature (1721974)..(1722022): n is a, c, g, or t
  misc_feature (1722825)..(1722925): n is a, c, g, or t
  misc_feature (1725108)..(1725207): n is a, c, g, or t
  misc_feature (1726837)..(1727879): n is a, c, g, or t
  misc_feature (1729395)..(1729494): n is a, c, g, or t
  misc_feature (1729968)..(1730067): n is a, c, g, or t
  misc_feature (1730718)..(1730819): n is a, c, g, or t
  misc_feature (1731088)..(1731187): n is a, c, g, or t
  misc_feature (1734605)..(1734704): n is a, c, g, or t
  misc_feature (1735665)..(1735764): n is a, c, g, or t
  misc_feature (1736474)..(1736576): n is a, c, g, or t
  misc_feature (1739213)..(1739312): n is a, c, g, or t
  misc_feature (1739869)..(1739969): n is a, c, g, or t
  misc_feature (1741780)..(1741879): n is a, c, g, or t
  misc_feature (1742103)..(1742202): n is a, c, g, or t
  misc_feature (1744287)..(1744386): n is a, c, g, or t
  misc_feature (1751623)..(1751722): n is a, c, g, or t
  misc_feature (1752655)..(1752754): n is a, c, g, or t
  misc_feature (1754512)..(1754611): n is a, c, g, or t
  misc_feature (1754986)..(1755085): n is a, c, g, or t
  misc_feature (1759088)..(1759187): n is a, c, g, or t
  misc_feature (1759567)..(1759666): n is a, c, g, or t
  misc_feature (1759929)..(1760028): n is a, c, g, or t
  misc_feature (1760272)..(1760371): n is a, c, g, or t
  misc_feature (1760664)..(1760763): n is a, c, g, or t
  misc_feature (1765680)..(1765779): n is a, c, g, or t
  misc_feature (1767133)..(1767232): n is a, c, g, or t
  misc_feature (1768650)..(1768749): n is a, c, g, or t
  misc_feature (1769594)..(1769693): n is a, c, g, or t
  misc_feature (1770020)..(1770124): n is a, c, g, or t
  misc_feature (1770385)..(1770485): n is a, c, g, or t
  misc_feature (1772425)..(1772524): n is a, c, g, or t
  misc_feature (1773627)..(1773855): n is a, c, g, or t
  misc_feature (1780737)..(1780836): n is a, c, g, or t
  misc_feature (1782697)..(1782717): n is a, c, g, or t
  misc_feature (1786283)..(1786382): n is a, c, g, or t
  misc_feature (1787172)..(1787272): n is a, c, g, or t
  misc_feature (1787317)..(1787365): n is a, c, g, or t
  misc_feature (1787424)..(1787436): n is a, c, g, or t
  misc_feature (1787763)..(1787986): n is a, c, g, or t
  misc_feature (1788298)..(1788397): n is a, c, g, or t
  misc_feature (1788731)..(1788830): n is a, c, g, or t
  misc_feature (1789898)..(1789997): n is a, c, g, or t
  misc_feature (1790317)..(1790431): n is a, c, g, or t
  misc_feature (1791819)..(1791918): n is a, c, g, or t
  misc_feature (1793973)..(1794072): n is a, c, g, or t
  misc_feature (1794276)..(1794375): n is a, c, g, or t
  misc_feature (1796323)..(1796422): n is a, c, g, or t
  misc_feature (1797741)..(1797746): n is a, c, g, or t
  misc_feature (1799876)..(1799977): n is a, c, g, or t
  misc_feature (1804861)..(1804960): n is a, c, g, or t
  misc_feature (1805619)..(1805722): n is a, c, g, or t
  misc_feature (1805925)..(1806029): n is a, c, g, or t
  misc_feature (1808772)..(1808795): n is a, c, g, or t
  misc_feature (1808862)..(1808936): n is a, c, g, or t
  misc_feature (1808985)..(1809015): n is a, c, g, or t
  misc_feature (1815547)..(1816507): n is a, c, g, or t
  misc_feature (1817139)..(1817238): n is a, c, g, or t
  misc_feature (1824098)..(1824197): n is a, c, g, or t
  misc_feature (1828527)..(1828626): n is a, c, g, or t
  misc_feature (1829378)..(1829477): n is a, c, g, or t
  misc_feature (1830070)..(1830169): n is a, c, g, or t
  misc_feature (1830546)..(1830645): n is a, c, g, or t
  misc_feature (1831339)..(1831438): n is a, c, g, or t
  misc_feature (1832757)..(1832856): n is a, c, g, or t
  misc_feature (1838469)..(1838499): n is a, c, g, or t
  misc_feature (1842813)..(1842912): n is a, c, g, or t
  misc_feature (1843166)..(1843265): n is a, c, g, or t
  misc_feature (1846822)..(1846921): n is a, c, g, or t
  misc_feature (1848956)..(1849055): n is a, c, g, or t
  misc_feature (1850429)..(1850528): n is a, c, g, or t
  misc_feature (1854287)..(1854386): n is a, c, g, or t
  misc_feature (1854711)..(1854810): n is a, c, g, or t
  misc_feature (1855625)..(1855725): n is a, c, g, or t
  misc_feature (1861896)..(1862047): n is a, c, g, or t
  misc_feature (1862947)..(1863046): n is a, c, g, or t
  misc_feature (1863902)..(1864001): n is a, c, g, or t
  misc_feature (1864415)..(1864514): n is a, c, g, or t
  misc_feature (1864938)..(1865047): n is a, c, g, or t
  misc_feature (1870630)..(1870729): n is a, c, g, or t
  misc_feature (1872265)..(1872382): n is a, c, g, or t
  misc_feature (1872836)..(1872848): n is a, c, g, or t
  misc_feature (1875015)..(1875063): n is a, c, g, or t
  misc_feature (1875585)..(1875624): n is a, c, g, or t
  misc_feature (1875769)..(1875880): n is a, c, g, or t
  misc_feature (1877457)..(1877559): n is a, c, g, or t
  misc_feature (1880106)..(1880205): n is a, c, g, or t
  misc_feature (1880572)..(1880671): n is a, c, g, or t
  misc_feature (1884817)..(1884916): n is a, c, g, or t
  misc_feature (1885320)..(1885430): n is a, c, g, or t
  misc_feature (1885653)..(1885752): n is a, c, g, or t
  misc_feature (1889352)..(1889464): n is a, c, g, or t
  misc_feature (1889902)..(1890001): n is a, c, g, or t
  misc_feature (1892433)..(1892532): n is a, c, g, or t
  misc_feature (1898775)..(1898874): n is a, c, g, or t
  misc_feature (1899313)..(1899412): n is a, c, g, or t
  misc_feature (1901566)..(1901665): n is a, c, g, or t
  misc_feature (1906754)..(1906853): n is a, c, g, or t
  misc_feature (1907730)..(1907737): n is a, c, g, or t
  misc_feature (1912267)..(1912366): n is a, c, g, or t
  misc_feature (1913874)..(1914348): n is a, c, g, or t
  misc_feature (1914904)..(1915003): n is a, c, g, or t
  misc_feature (1919030)..(1919198): n is a, c, g, or t
  misc_feature (1920004)..(1920107): n is a, c, g, or t
  misc_feature (1923639)..(1923738): n is a, c, g, or t
  misc_feature (1924388)..(1924487): n is a, c, g, or t
  misc_feature (1931658)..(1931710): n is a, c, g, or t
  misc_feature (1936615)..(1936714): n is a, c, g, or t
  misc_feature (1938939)..(1939038): n is a, c, g, or t
  misc_feature (1939634)..(1939733): n is a, c, g, or t
  misc_feature (1940171)..(1940297): n is a, c, g, or t
  misc_feature (1944216)..(1944315): n is a, c, g, or t
  misc_feature (1946780)..(1946905): n is a, c, g, or t
  misc_feature (1955221)..(1955320): n is a, c, g, or t
  misc_feature (1957957)..(1958056): n is a, c, g, or t
  misc_feature (1960050)..(1960149): n is a, c, g, or t
  misc_feature (1963794)..(1963969): n is a, c, g, or t
  misc_feature (1964596)..(1964615): n is a, c, g, or t
  misc_feature (1964670)..(1964793): n is a, c, g, or t
  misc_feature (1965334)..(1965433): n is a, c, g, or t
  misc_feature (1965800)..(1965903): n is a, c, g, or t
  misc_feature (1966284)..(1966389): n is a, c, g, or t
  misc_feature (1967071)..(1967172): n is a, c, g, or t
  misc_feature (1971224)..(1971323): n is a, c, g, or t
  misc_feature (1975423)..(1975522): n is a, c, g, or t
  misc_feature (1976736)..(1976957): n is a, c, g, or t
  misc_feature (1977424)..(1977523): n is a, c, g, or t
  misc_feature (1982866)..(1982965): n is a, c, g, or t
  misc_feature (1983344)..(1983443): n is a, c, g, or t
  misc_feature (1990960)..(1991074): n is a, c, g, or t
  misc_feature (1994562)..(1994661): n is a, c, g, or t
  misc_feature (1998754)..(1998853): n is a, c, g, or t
  misc_feature (2001782)..(2001886): n is a, c, g, or t
  misc_feature (2003972)..(2004071): n is a, c, g, or t
  misc_feature (2006806)..(2006905): n is a, c, g, or t
  misc_feature (2011405)..(2011446): n is a, c, g, or t
  misc_feature (2011689)..(2011855): n is a, c, g, or t
  misc_feature (2012101)..(2012200): n is a, c, g, or t
  misc_feature (2013369)..(2013470): n is a, c, g, or t
  misc_feature (2014370)..(2014470): n is a, c, g, or t
  misc_feature (2014994)..(2015094): n is a, c, g, or t
  misc_feature (2015181)..(2015220): n is a, c, g, or t
  misc_feature (2015364)..(2015367): n is a, c, g, or t
  misc_feature (2015442)..(2015817): n is a, c, g, or t
  misc_feature (2016189)..(2016198): n is a, c, g, or t
  misc_feature (2016247)..(2016258): n is a, c, g, or t
  misc_feature (2016888)..(2016906): n is a, c, g, or t
  misc_feature (2018074)..(2018630): n is a, c, g, or t
  misc_feature (2018854)..(2018953): n is a, c, g, or t
  misc_feature (2019952)..(2020070): n is a, c, g, or t
  misc_feature (2020284)..(2020383): n is a, c, g, or t
  misc_feature (2021581)..(2021680): n is a, c, g, or t
  misc_feature (2023807)..(2023834): n is a, c, g, or t
  misc_feature (2024662)..(2024686): n is a, c, g, or t
  misc_feature (2026083)..(2026182): n is a, c, g, or t
  misc_feature (2027454)..(2027553): n is a, c, g, or t
  misc_feature (2027821)..(2027920): n is a, c, g, or t
  misc_feature (2028309)..(2028435): n is a, c, g, or t
  misc_feature (2029148)..(2029193): n is a, c, g, or t
  misc_feature (2029250)..(2029435): n is a, c, g, or t
  misc_feature (2030397)..(2032102): n is a, c, g, or t
  misc_feature (2033628)..(2034280): n is a, c, g, or t
  misc_feature (2034623)..(2034722): n is a, c, g, or t
  misc_feature (2035886)..(2035985): n is a, c, g, or t
  misc_feature (2039284)..(2039383): n is a, c, g, or t
  misc_feature (2040310)..(2040583): n is a, c, g, or t
  misc_feature (2040879)..(2040978): n is a, c, g, or t
  misc_feature (2042149)..(2042248): n is a, c, g, or t
  misc_feature (2043332)..(2043431): n is a, c, g, or t
  misc_feature (2044391)..(2044492): n is a, c, g, or t
  misc_feature (2045320)..(2045541): n is a, c, g, or t
  misc_feature (2046277)..(2047076): n is a, c, g, or t
  misc_feature (2047927)..(2047953): n is a, c, g, or t
  misc_feature (2048090)..(2048563): n is a, c, g, or t
  misc_feature (2048997)..(2049096): n is a, c, g, or t
  misc_feature (2053604)..(2053703): n is a, c, g, or t
  misc_feature (2054097)..(2054211): n is a, c, g, or t
  misc_feature (2054466)..(2054565): n is a, c, g, or t
  misc_feature (2056021)..(2056120): n is a, c, g, or t
  misc_feature (2056391)..(2057014): n is a, c, g, or t
  misc_feature (2058190)..(2058291): n is a, c, g, or t
  misc_feature (2058815)..(2058920): n is a, c, g, or t
  misc_feature (2059481)..(2060895): n is a, c, g, or t
  misc_feature (2063964)..(2064064): n is a, c, g, or t
  misc_feature (2064943)..(2064946): n is a, c, g, or t
  misc_feature (2066609)..(2067383): n is a, c, g, or t
  misc_feature (2068411)..(2068511): n is a, c, g, or t
  misc_feature (2069037)..(2069136): n is a, c, g, or t
  misc_feature (2070340)..(2070807): n is a, c, g, or t
  misc_feature (2071086)..(2074325): n is a, c, g, or t
  misc_feature (2082201)..(2082300): n is a, c, g, or t
  misc_feature (2084468)..(2084570): n is a, c, g, or t
  misc_feature (2085647)..(2085746): n is a, c, g, or t
  misc_feature (2085956)..(2085964): n is a, c, g, or t
  misc_feature (2086758)..(2086858): n is a, c, g, or t
  misc_feature (2087559)..(2087658): n is a, c, g, or t
  misc_feature (2088492)..(2088591): n is a, c, g, or t
  misc_feature (2089779)..(2090224): n is a, c, g, or t
  misc_feature (2090579)..(2090679): n is a, c, g, or t
  misc_feature (2092133)..(2092232): n is a, c, g, or t
  misc_feature (2094318)..(2096569): n is a, c, g, or t
  misc_feature (2098179)..(2098278): n is a, c, g, or t
  misc_feature (2098943)..(2099007): n is a, c, g, or t
  misc_feature (2099716)..(2099815): n is a, c, g, or t
  misc_feature (2101053)..(2101152): n is a, c, g, or t
  misc_feature (2101497)..(2102554): n is a, c, g, or t
  misc_feature (2102811)..(2102911): n is a, c, g, or t
  misc_feature (2103122)..(2103138): n is a, c, g, or t
  misc_feature (2103205)..(2103314): n is a, c, g, or t
  misc_feature (2103624)..(2103723): n is a, c, g, or t
  misc_feature (2104926)..(2105025): n is a, c, g, or t
  misc_feature (2105257)..(2105367): n is a, c, g, or t
  misc_feature (2106738)..(2107252): n is a, c, g, or t
  misc_feature (2114801)..(2116034): n is a, c, g, or t
  misc_feature (2116332)..(2116431): n is a, c, g, or t
  misc_feature (2116706)..(2117127): n is a, c, g, or t
  misc_feature (2117536)..(2117767): n is a, c, g, or t
  misc_feature (2118525)..(2118624): n is a, c, g, or t
  misc_feature (2122172)..(2122271): n is a, c, g, or t
  misc_feature (2125126)..(2125231): n is a, c, g, or t
  misc_feature (2125473)..(2125572): n is a, c, g, or t
  misc_feature (2126359)..(2126458): n is a, c, g, or t
  misc_feature (2139673)..(2139772): n is a, c, g, or t
  misc_feature (2142279)..(2142379): n is a, c, g, or t
  misc_feature (2145886)..(2147969): n is a, c, g, or t
  misc_feature (2149169)..(2149718): n is a, c, g, or t
  misc_feature (2153028)..(2153155): n is a, c, g, or t
  misc_feature (2155127)..(2155232): n is a, c, g, or t
  misc_feature (2155440)..(2157825): n is a, c, g, or t
  misc_feature (2158368)..(2158467): n is a, c, g, or t
  misc_feature (2159214)..(2159270): n is a, c, g, or t
  misc_feature (2159312)..(2163761): n is a, c, g, or t
  misc_feature (2166509)..(2166888): n is a, c, g, or t
  misc_feature (2167326)..(2167425): n is a, c, g, or t
  misc_feature (2167784)..(2169452): n is a, c, g, or t
  misc_feature (2169662)..(2169763): n is a, c, g, or t
  misc_feature (2170727)..(2170826): n is a, c, g, or t
  misc_feature (2174269)..(2174385): n is a, c, g, or t
  misc_feature (2175462)..(2175564): n is a, c, g, or t
  misc_feature (2176243)..(2177344): n is a, c, g, or t
  misc_feature (2179344)..(2179791): n is a, c, g, or t
  misc_feature (2180463)..(2181607): n is a, c, g, or t
  misc_feature (2181971)..(2182114): n is a, c, g, or t
  misc_feature (2182149)..(2182649): n is a, c, g, or t
  misc_feature (2182874)..(2182896): n is a, c, g, or t
  misc_feature (2182982)..(2183913): n is a, c, g, or t
  misc_feature (2184115)..(2184949): n is a, c, g, or t
  misc_feature (2192010)..(2193956): n is a, c, g, or t
  misc_feature (2205486)..(2205585): n is a, c, g, or t
  misc_feature (2206557)..(2206656): n is a, c, g, or t
  misc_feature (2208809)..(2209507): n is a, c, g, or t
  misc_feature (2210305)..(2211193): n is a, c, g, or t
gagtatgcgattcttcctgaattagctttccgtgttgaatatcaatggttgagcaatgtaggtaacttcactaaagctgaagcgaaagagaatcgtagagcaacttacaactatagcccagattctcattctgtgaccgcaggtatttcatatcgctttggtcaaggtgcagcaccagttgcagcagcaccagaagttgtaactaaaaacttcgcgttcagctcagacgtattatttgacttcggtaaagcaaacttaaaaccagctgcagcacaaacattagacgcagtacacactgagatcgtaaatttaggtttagcaaaccctgctgtacaagtaaacggttacacagaccgtattggtaaagatgctgccaacttaactctttcacaaaaacgtgcagaaacagtagcaaactacatcgtttctaaaggtgttaacccagctaacgtaacagcggtaggttacggtgaagctaacccagtaactggtaacacatgtgacgcagttaaaggtcgtaaagcattaatcacttgcttagcaccagatcgccgtgttgaaatccaagttcaaggttcaaaagaagtttctatgtaatcacttttgaatccaagaaacttaaaaaatgcccgcaaaagcgggcatttttattataccgagaaacttttattctttattttacccatctatttcttcaccggtttgatcccacttaaagtttaatgcaatagaatttaagcagaagcgtaatcctgtaggttgaggcccatctttaaaaacgtgtcccatatgggcatcacaattgccacagcgaatctcaacacgatgtctgcctaaactataatcatctacataacgtaatgaagactccgagatcgtttcataaaaacttggccagccacaaccagcatcaaatttggcatcagaacgaaataacgcattatggcaacgaacacagcgatatgtccccaccctattttcttttaggaacttaccactgaaaggtttttctgtacctgcatttaaacaaatttcaatctgttcttcggttaattcactaatatctttaatcattttaaatccttttctcttattggtttgttaccaattattctaactttttttagttaaaagcaagagagggttttaaaaaatttgacatagatcacataaaatttatctgctatattttgctctgttctttagttgtcagaaaagggaaagattgtgttataatcctctcgcttttccaatgtctaggaaagaacaaattttgtttaactttaatataggtagaaaatctatggcaattaaaattggtattaacggctttggccgtatcggtcgtatcgtattccgtgcagcacaaaaacgtgatgacatcgaagtagttggtatcaacgacttaattgatgttgagtatatggcatatatgctcaaatacgattcaactcacggtcgtttcgatggcactgtcgaagtaaaagacggcaaattagttgtaaacggtaaagaaatccgtgttacttctgagcgtgacccagctaacttaaaatggaatgaaattggtgtggatatcgcagttgaagcaacaggtttattcttagacgatacaactgctcgtaaacacatcgaagctggtgcgaaaaaagtcgttttaactggtccatctaaagatagcacacctatgttcgtaaacggtgtaaacttcaacgcttatgctggtcaagacatcgtttctaacgcttcttgtacaacaaactgcttagcaccacttgctcgtgttatccacgaaacatttggtatcaaagaaggtttaatgacaactgttcatgcaacaacagcaacacaaaaaactgttgatggtccatcagcaaaagactggcgcggtggtcgtggtgcggcacaaaacatcattccatcttcaacaggtgcagcgaaagcagtaggtaaagtattaccagcattaaacggtaaattaacaggtatggcgttccgtgttccaacagcaaacgtatctgttgttgatttaactgtaaacttagaaaaaccagcaagctacgaagagatcaaaaaagcgatcaaagatgcagcagaaggtaaaacattcaacggcgaattaaaaggcgttttaggttatactgaagatgcagtagtatcaacagacttcaacggtgcagttgaaacttctgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcattaacagatacattcgtgaaacttgtttcttggtatgacaacgaaactggttactcaaacaaagtattagacttagttgctcacatttacaactacaaagactaattaaaatagtaatattggaaatggcaatatataaatctatattgccattttttatatagaaataagcctatatgaagtagtatataataaattaccaattcacggaattatttatagcctcacgttgttctgaatgagatagtcttagagataaagcagtcatatttacatttgaatgccctaacagatcggctaataaagcaatattattatttttctttaaaaattgtatagcaaagaaatgcctaaaattatgagggtggacaacatcttttctgatgcgacacttttctgcgtatattttcaaattatgagcaatacctctagctgaaataggtgctccatatctattcaggaataattcttttttatgattttgaaaaattcacgagattcattaatcaggctttgaggaatattaattcttctaaattttcctttagaatggcattcagcatatcctttttctaaatcttgtattgtgaattttactagttcacttattctagctccagtgcttcctaagaaccttacaataaagtaataacgtaaattatattcctttaaataatcgcatagagttttgtattctggaaatgacatgattccttctgtaaaatgatacttaggtaatggaatatgctttaatttaaatggttttatattcttatgattgaaaatactttgataaaaaattgatattaaatattatatcttatatttattgatcctcctattaaaaataattctaaatttatcactattaaaagtaagttcgtaatatattttatatgtttttttatcttaaaaataattaacttttgtattgaagttgattatttaaaatgttataattaaccttctttctatagaaggttttcacttaataattgaatagcttatagaaataattaggtatgtttacaacgcaattaggaaattttaatgagtgaattggctaaagatattattcctatcagtattgaagaggaactaaaaaattcctatcttgattatgcaatgtctgtgattgttgggcgagcgttaccagatgtgcgagatggtttgaagcccgttcatcgacgcgtacttttttctatggatcaaagcggtaacgtatcatctaaaccttatgtgaaatcggcacgtgtagtcggtgatgtgatcggtaaatatcaccctcacggtgattctgcggtgtatgatacgattgtgcgtatggctcagccgttctctcttcgttatatgttggtagatggtcaagggaactttggttcgattgacggggatgcgcctgcggcaatgcgttataccgaagtgcgtatgcagaagattacacaagaattgttaacggatttggataaagaaacagtggatttctcgccaaattatgatggtaaagagatgatccctgatgtattaccgactaaaattccggcattgcttgttaatggttcttcgggaatcgccgtgggtatggcaaccaatattcctcctcataacctaaatgaagtgttaaacggttgcttagcttatattgaaaacgaacaaattacgattgaagagttgatgcaacatattcccggtcctgatttcccaacggcggcgattattaatggtcgtaaagggattgaagatgcttatcgtacaggtcgtggcaaagtgtatgtacgagccaaagccagtgttgaaacaacttcaaaaggccgtgagcagattgtcgtcacggaattgccgtatcaagttaataaaaagaatttaatcgaaaaaattgccgaattggtgcgtgataagcgtattgaaggtatttcaagtattgaagactattctgataaaaaagggatttcgattgttattgaaatcaaaaataatgctgttggtgaagtggtactcaataatttgtacgctctcacacaaatgcaagtgactttcggtatcaatatggtggcactcgatcatggtcagccaaaaattttcaatctcaaacagattattgaagctttcgtgatgcaccgtcgtgaagttgtaacacgccgtacggtctttgaattgcgtaaagcacgtgaacgtgcacatattttagaaggtctagcgattgcattagccaatatagatcctgtgattgagctgattcgaaattccaaaactgccgatgaagcacgtgaaggtttattggatcgtccgtggtcgttaggtaatgttgcaccaatgcttgaagcagcgggtgtagatgcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctcagagcgtttaatggaagtcatccgtgaagagcttgaaaaaatcaaagccgaatttggcgatgagcgtcgcactgaaattactgcggcttcaggcgatattaatttagaagatttaattgctcaagaagatgtagttgtgaccttatcgcacgctggttatgtgaaatatcagccgttatcggattacgaagcacaacgtcgtggtggtaaaggtaaatcagcaacgaaaatgaaagaggatgatttcattgaaaaattattggtcgctaatactcatgataccattctctgcttctcaagctgtggtcgtttatatcaattaaaagtctatcaattaccacaggcaagccgtggtgcaagaggtactccaatcgtaaatattcttccacttgtaaaaggggagaatgagcgtatcactgcaattcttcccgttccaaatggtgaatttagcgctgataaatttatttttatggcaacggcgagtggtacggtgaaaaaagtttcgctcgatgcatttagtaatgttagatcaagcggtctaattgcattaaaacttcgcgagggtgatgaattaatcggggtagatattaccaatggcgagagtgaaatcatgttgttctcggcacaaggtcgagtggtacgctttgcagaaactgcagtgcggggaatggggcgtgttgcaacaggggttcgaggtattaaattagcaacaaccgaaatttcagtcgatgatgctgaagaagtcgatattgaaactgttgaaaacgaagaagctgaagaagcctcaagtgttaacttaaccaccgataaagtggtttcccttgtaattccacatactcaaggtgaaatcttaaccgttacccaaaacggttatggtaaacgtactgccttaggtgagtatccggtcaaatctcgtgcaacaaaaggggtggtttcaattaaagtgaatgaacgtaacggtaaagtggttgcagcagttcaggttgaagaaaatgaccaaattatgttgattaccgatgccggtacattagtacgtacccgtgtaaacgaagtcagccttgtaggacgtaatacccaaggtgttcgtattattcgtaccgcagaagacgaacatgttgtcagccttgaacgaatctgtgaaattgaagacgacggtatagaaaatttatctgttgaagaagcataatttattaaggctgtgattcacagccttaatattttgtaagataatgccttatttttattgggattgtcctaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcattggtatatcctcttccattttagaacgctatcaattatacaacatcattatgtagatgaaatgctaaaaatcaaacgaaaatctgagaataaagtgaaagatatttccgtattaaatgctcaaatatccttaaaaatcacctacttaatgagatcaattatcactacatagcattctgaaaattatttttttgagatagatcacaaaactatttttttatgttacaaaattgtaaaaattcattataaaatatccaaattaatggcaaaatgcttccatattaggtttatatactttactttcccaaggaggaaatcgtgcaaactgtcaatgtagatgttgcaattgtgggtgcaggtggcggtggtttaagagccgcaatcgcagcagcagaagctaacccgaatttgaaaattgcattaatttcaaaagtttatcctatgcgtagccatacggttgctgcagaaggtggggcggcggcagtcgctaaagaggaagactcttacgataaacacttccacgatactgtggcaggtggcgactggctttgtgaacaagatgttgttgaatatttcgtagaacactcgccagttgaaatgacgcaattagagcgttggggctgtccgtggagccgtaaagctgatggtgatgtgaacgttcgtcgtttcggtggtatgaaaattgaacgtacttggttcgcagccgataaaacaggtttccacttattgcataccctattccaaacctcaatcaaatatccgcaaattatccgttttgatgagcattttgtcgtggatattctcgttgatgaaggtcaagctcgtggctgtattgcaatgaatatgatggaaggaacttttgttcagatcaatgcaaatgcggtagttatcgcaacaggtggtggttgccgtgcttatcgtttcaacaccaacggcggtatcgtaacgggtgacggtttatcaatggcgtatcgccacggcgtgccacttcgtgatatggaatttgtacaatatcacccaacaggcttaccaaacacaggtatcttaatgaccgaaggttgtcgtggtgaaggcggtatcttagtcaataaagatggctaccgttacttacaagattatggtctaggcccagaaactccagttggcaaaccagaaaataaatatatggaattaggccctcgtgataaagtttcccaagcattctggcaagagtggcgtaaaggtaacaccttaaaaactgccaaaggtgttgatgtggttcaccttgacctacgtcacttaggtgaaaaatatttacacgaacgtctgccatttatctgtgaattagcacaagcctacgaaggcgtagatccagcgaaagcaccaattccagttcgtccagttgttcactatacaatgggtggtattgaagttgatcagcacgcagaaacctgtatcaaaggcttatttgcagtgggcgaatgtgcatcttctggtttacacggcgcaaaccgcttaggttctaactcattagcagaacttgtggtattcggtaaagttgcaggtgaaatggctgcaaaacgtgctgttgaagcgaccgctcgtaatcaagccgtaattgacgctcaagcaaaagatgtcttagaacgtgtttatgccttagcccgtcaagagggtgaagagtcttggtcacaaatccgtaacgaaatgggcgactcaatggaagagggttgtggtatttatcgtactcaagaaagtatggaaaaaaccgtagcgaaaattgcagagttaaaagagcgttacaaacgtatcaaagtgaaagacagctcaagtgtatttaatacagacttgctctacaaaattgaacttggttatatccttgacgtagcacaatctatctcatcttctgcggtagaacgtaaagagtctcgtggtgcacaccaacgtttagactacgttgaacgtgatgatgtgaactacttaaaacacacccttgcattctacaatgcagacggcgcaccaacaatcaaatacagcgacgtgaaaattaccacatcacaaccggctaaacgtgtttatggtgcagaagcagaagctcaagaaaaagcagcgaaaaaggagtaacagaagatgactaaccaaagtaaaatgacggtagaagtacttcgttataaccctgaacaagataacgaaccgtacttatcaaaatatgaagtgccttacgatagccaaacttcgttacttgatgcacttggttatatcaaagatgaattagagccagagctttcatatcgttggtcttgccgtatggcgatctgtggctcttgcggtatgatggtaaacggcaaaccaaagcttgcatgtaaaacattcttacgcgattacagcggttatatgcgaattgaaccgcttgcaaacttcccgattgaacgtgacttagttgttgatttaagccacttcatcgaaagtttagaaagcatcaagccatacattattgacaacaaagcgcctgaacttgatggcaaaccacacccatcagcagagcttgcgaaaagccgcaccaaacaaaccccagcacaacttgagaaataccgtaccttctcaatgtgtattaactgcggtttatgctatgccgcttgcccacaatttggcttaaaccctgaatttgtaggcccagcagcattaaccttagctcaccgttacaacctagataaccgtgataatggtaaagcggaacgtatgaaaattatcaacggtaaaaacggtgtatggagctgtacattcgtcggctactgctctgaagtctgtccgaagcacgttagtccggcctctgcggtaaaccaaggtaagatcgaaagtgccaaagattatgtctttgcaatgttaaaaccgcaaaagtaaggagagagtaaaatgacaacagcagcaagtaaacgcaaaaaatatgtgcgtgaagtcaaaccaacttggtggaaagcgttagatttttacaaattctacgttttgcgtgaaagcacctctgtaccaacagtttggttctgtttagtgcttttctannnnnnnnnnnnnnnnnnnnnnnnnnnnnnnnnnnnnnnnnnnnnnnnnnnnnnnnnnnnnnnnnnnnnnnnnnnnnnnttaaacatcatcactctaggtgcagtattactaaacagctttaccttcttcggtatggcacctcaaatgatgaacgttatcgtgaaaaatgaacgtattgacgttaaactcgtttctcgcgtattttggggtattactgctttcgtaagccttttagctttaatcttggtatagggagagcataaaaatggataaacttaatcctccacgttcaaatgaacctgcagtatggttacttttcggtgcaggcggtgcgatcagtgcaatcttcttccctgtgcttgtattaatcttaggtttcttactgccattcggactgattacaccagataatattatttcatttgcacatacttggatcggtaaactcgctattctagcattactaatattcccaatgtggtgtggtatgcaccgtatccacctaggcttgcacgattttaaagtacacgttcctgcaggcggttggattttctatggtttatctgcactttatagtgtattagtgatttttgcggtgattaatttataagttaaagtcttgttgaacagctattccctgtaagaaatagctatttataatagacatttttcttgtcttctttgagataagctcatataattagggcatctgctgtataaatgtagatgtctttctatgaggaaactttgggcttctcgcagtagtctttaatttacttggtcaggttcggaagaaagcagccagaattagaatagctaagtgccgagtctatgcttaaagtttcctctcccttaactagtcttttgggagaagaaaacatacgcactgctttataagattagttcctctgttaatgtcggctttccgttaatcatgcagagctcttttgtactcattaacccacattgctgtagcaccacacacggcaacaggcattaccactaagttaataaatggcaacatcgtaaaaatacttaccaaagccccaaaagtaaaattcattgtacgatattgtgctaatgcatttcgcatacgttgaaattgaattttatggttatcaaaagggtagtcgcaatattgaattgcaattaaccaagccccgaaaataaatgccaagatagggataatagtctgccctaaaacaggtataaaacctaataaaaataaggcaaccaaacgtggaatgctataccacattttttgccactcacgtttgagcatacgaggtacatcttttagcatttcgttaaaactcatttccgtgagattttcaccagtgagttgttgctcaactttttctgcgagtaacgcattaaatggggcagcaataaaattcgctaaagtggtaaaagcaaagtagaaagcaactaaaatcattaaaaaagccaatggaataagaataaagctcaaccattctaaccacgaaggcaagagcgaatctaacattccccctacattggcaaaaaagagccaaattaggctaatcatcaacactgcattgataattacaggaaaaataataaatggcattaactgacgctgtaacattaatcgccaaccatagatgaaatagtgaaagccagcaccaatttgtgtttctggggtagaaaatagcgaagacataattaacctttctattcaaatttttagaagaaatatggtaagctatgcacacattttcacaaagtgttaaatttcaattttgatgattttatgagctaaagagggcaaaatggaaactcatattcttttctttattttagcaggattattaatcgctgttttaattggatacagtatttggtctgcacgcagagaaaaatctcgtattttttcaaataccttttctactcgtccaccttcgtctccaattagcaatgaaattacagcagatattccaacaacgctaaatcctcaagatgtcgtagctcagcaaccattcaatactgaaacacctgctgattttattcaatctcagcaagaagttgagaatagtgtcaaaaatattcgtattagtttacaaactcaagaaatatctcaacctctatatcaagagactatgccagaatctccatctgaagcatatcaacaaaatcagatacaagaacagactgtccaagtagagcaagttgaaacaatagaacaaactacggagcataatataatcactttgtatgttgttgcaccagaaggcgttcaatttcaaggtaatgccattgtacaaaatttagaaatgttaggttttcattttggtgaatatcagatcttccaccgtcatttagataatcctgcaagtcctgtattgttcagcgtggcgaatatgatgcaaccaggagtctttgatttagcaagaatggaacagttttctaccgtgggattagtattctttatgcacctaccttcagtaggtaatgatctagctaatttaaaattaatgattcgtaccgtagagagctttgctcaatctgtcggcggttttgtcttagatgaacaacatcaaatttttaacgatgaatctcgccaaaattatctactgcgagtagccaactaatttgcaatacactgtttaaatatgaccgcttgcaagcggtcttttttatcgagaaatttacagatgccacactctattgaaacccaacttgaacatttgcgtgaaaaattgcgtgaatatgaataccactaccacgttttagataatccgcttgtacccgatgcagaatatgatcgcttgatgaacgagttaaaaaatctggaatggcaatatcctgaattaatcacgtccgattcaccgacacaacgggttggtgctaagccgttagatggttttgctcaaattacccacgaaattccaatgctttctctggataacgccttttcagatgatgacctcacaggctttttgcgtcgtattgaagatcgtattgcaatcaacagtaatcaaattgaattttgttgtgagccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttagcggtgagtattctgtatgttgacggagtgctaacccaagcggcaactcgtggcgacggaacaacaggggaagatattaccgccaatatccgcacgatccgtaatattccgttaaaactaaaaagtagtaatccgccacatcgtttagaagtgcgtggtgaagtttttatgccacagcagggctttgaacaattaaatgaaaaagcactggcaaaaggtgagaagacctttgctaacccgcgtaatgcagcggcaggttcacttcgtcagctcgatccgaaaatcactagacaacgtccgttaatgttgaatgcctataacattggggtttatgaaagtgatgatgaactccctacgacacattttgaccgcttgcagtggttaaaaaccctggggattcctgtcaatgctgaaattaccttagcaacaggttctcaagccttgactgcgttttatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaatccaagccaaacgtagttcgctgggttacgacattgatggcacggtgttgaaagtcaataagattgtgctgcaagaacagcttggctttatctcaaaagcacctcgttgggcaattgcttacaaattccctgcacaagaagagatgacgattctgaacgatgttgaatttcaggtcggcagaacaggggcaattactccagtggcaaaattagaacctgtctttgtggctggggtaacggtgagcaatgccaccttacataacggtgatgagattgagcgtttagggatcgcaattggtgataccgtgattattcgccgagcaggtgatgtaattccgcaaattgtgggcgttgtggctgaacgtcgtcttgacaatgcaaaaaaaattgcttttccaaccgcttgtcctgtgtgtaactcagctgtagtacgtgttgagggcgaagctgttgctcgttgtactgggggattattctgcggagcccaacgtaaagaggcgttaaagcatttcgtttcacgcaaagcaatggatattgacggcgtgggtgaaaaactgattgaacaactgatggaacgtgagctgatccataccccggcagatctgtttaaactcgatcacaccaccttaatgcgtttagagcgaatgggagaaaaatctgccaataacgcactacaaagtatcgaaaaggcgaaaaatacaacccttgctcgtttcttatttgccttggggattcgagatgtcggagaatctaccgcacaaaatctcgcaaatcactttggtacgcttgatgcgattcgccaagcggatttagacacactaaaacaggtacaagatgttggggaagtggtggcaaaccgcctattccaattctggcaagaaccacataatattgaagtggtggaagatttgattgctcaaggggtgaagtggcaagatgtggtgcaacaagagattgcagacaatccattaaaagataaaacagtggtactaacagggacattaacacagctcacccgtgatcaagcaaaagccttattacagcaattgggttgtaaagtatctggcagtgtatcaagtaaaacggattatttgattgcaggggaaaaggctggttcaaaattggcaaaagcacaggaattgggagtgaaaattttgagtgaggacgagttaattggatattttacgactatagtatcgtaatatgtgaagcaagagtttgattttaactttagggctaatctaatacagcccctaaagttaatcacaagcaatactttctatatgatataaatgctctctaataagccctaaaaacgcctctccaaacctctccagttttctctcacctaccccattaatggaaagcatttcatctgccgtcgttggcataaattctgccatttcttgtagggtagcgtcattgaaaaccacataaggagggatattttccttatcggcaatctgtttgcgtaaaaagcgtaaacgggcaaaaagatctttatcataccgcttgctagcttgctgtttctgcacataagttgtcgccgaaaaactgaaacgtggggaagccagtgccaaggctgtttcaccgcgtaaaatggggcgagcttgttctgtgagttgtagggcagaatgattaacaatgttttggcgaataaagccaagatgaatgagctggcgagttacgctaatccaatattcttgcgatttatccttgccaatcccatagacagatagagtgtcgtgttgatattcacggattttttgctgatttaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgctgatttaagccccgaagaactgcaataatatgatgtaagccgaagcgttgtcctgtgcggtaaataacggacatcactttttgggcatcaactaagccatcatactttttcggtggatcaaggcaaatgtcacaattttgacaagcaacttggcgtgtttcaccaaaatagttgagtaacacaaggcgacggcaagtttgtgattcggcaaaagccccaatggcttgcaatttatgttgctcaatttgacgttgttcactttctggtttttctagtaataccttgtgtagccaaccataatccgcaggatcgtaaaataacaccgcttccgcaggaagatcatctctccctgctcgtcctgtttcttgataataggcttcaatgcttcttggcagatcaaaatgcacaacaaaacgcacattggatttgttgatccccattccaaaggcaacagtagcaacgacaatttgaatattatctcgttgaaacgcattttgaacggtttcccgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgcatcgtcattcctgcgtgatagcccattacagaaaaacggcgagaagaaagtttttccgtgagttcttcaacttttttacggctattacaataaacaatcccacttttcccttgctgactgctgataaatttgatcagttgatccacaggtttaaatttttcttgcaccgtatagcgaatgttaggacgatcaaaacttcctaaataagtatggggatcttctaacttaagatgatgaataatatcaaaacgggttgtcggatcggcagttgcagtcagtgcaacaagcggtatgtttgggaaagtttttcgcaaaccgcctaacaaggtgtattcagggcgaaaatcgtgtccccattgagatacgcaatgtgcttcatcgactgcaatcaggctaattttgcacaatgagataaattgaaaaaaatttgatgtcattaccttttcgggtgaaaggtaaagtagcttgagttgtcccgaaatcgctttttgttcaaccgcttgctgttcttcaatagtttgagtggaattaatatagcctgcttcaacaccattggtgagcagttgatctacctgatccttcattagcgaaattaaaggtgagatcacgagagttatgccttcaaaacagagggctggcacttgataacaaagggattttccgccccctgtcgtcataatcaccaagcaatctttgcccgacaagatcgcttcaatcacttctgattgaccttgtcggaaagattggtagccgaaaacgttatgtaaaaccgtttcagctttggcaagcggtataactgacattagctaaaagagatcttttcgccgtgacgagcgactgcctcttctaaatgtgtccaaaatgaacgcccttccgcactgacccaatcgccatcacgataggcaaagtgataacctcctaatttacttgccagccaaagttcaagcatagcttcttgcttgttaatgacaatttgtgaatcatcatcaaaagtaatagtaaaaacagccccttgtgtttcacaatcgacatcgcaaccttgttcttcaagttgttcttcaatatgttcccacacttgttcaatcgcttgatgaaattctgctaaattcataaataatctcttcgtaaagccaaaatttgaaaggcgttattttggatttttctgaacattttttcaatcgaaatctgaaggattacatccaagcgttgctacgaataacgccgacagcaatgccttcgatttcaatataagattgacgaggatcgatgataatcggctctaattcatcattttctgggtgtaaatagattaagtcaccttttttctctaagcgtttgacggtcacttcatcatcaacacgagcgacaaccacttgcccattacgaacagatttggttttatgcactgcgagtaaatcaccatctaagatgccaattttctccattgagttcccattcaccttaagaaggtaatcagcggctggtgaaaacattgctccattcacaggataatgtttttcaatatgttcaatcgcctcaatcggcgtacctgctgcaactttgccaattaaaggcaagccctcttcatcatttgcggcttcatcttccactaaaatacggatcccacgcgaagttcctgaaagcatttcaatatagcctttacgagcaagagctttaagatgttcttctgcggcatttggcgatttaaaccctatttcgcgtgcaatttctacacgagttggcggcatccccgtactttcaatatgattttttacaaattcaaagatttcttgctgacgagccgttaggtgctgacgtttcataagttcctcactgtctttatatacagaaatttatgacattatatacagtaaaatttcatttgcaacgaaataattttagatttctgtaagaaatgaagaatggagttagcttaattaacggcacggacacactgcgtgtgcccgttttcattagttgaaatgattgcaaagacagctcgcttggtgtccttgtttattttgtattcatctctgcatatttatcacaacctgcttgacttcccatatcgcaagaaatgccaaaataggctttggcataatattttaaatccatatctagaaaaaaaacatttgcctgtttgaaaaagcgttcagcaccattattagcctgtaattcttctctaatctgttggattttatcttgggcaactttatcaagtatctcatctttgtctttaagaacaactaattccatttttaagtgttcaatatccttaaaaacttctttggaatattgaccgcgagcatgattctctagtaaagcaatatattctgttaagattttttccgctttagcaatatcaggggttattccaatccctaaataatataatatagcaagtttctggtaannnnnnnnnnnnnnnnnnnnattatgttttttagtgttttcataatatttatcagcccaataaaatgccttttcccagttatggttatctttatcattaaaatagaaatcgattaaatccacctgagcacgaagataatccattttagctaattcttctaatacagggatatttttatagtcatattttgccagcatatctccaagtgatgctgctttagctaaaaatgtttttctttcataactgttaccatcataggtataagctaatgatctatatgctggtgcaaagttttgatttgctgcacggctaaaccatttttttgcttcctctttatttttttctttccgataatacctacccaattgatattgtgcaatcggataatttttttccgcaagctgttttaatctatcgattgggaaaatatctaattccgctttagctaatttatcgcgataaaattcacgttgatgaattaaaatttctaatcggctaatatctttatgatcgggataaagttgagtgtaataatagccaccgccacaaacagcagcgagtaaagtgagtgcggttaaaattttggttgtttttttcattttataatcctttaatgttgagtaatgttattaattgataatttaagaatgttctgtaatttatttttaatacttactaaaacgttgttttgctgctgcaacgacactatgctgtttattaaacaaacttatttggggaaagtctttaatgtctgcaaataagtgtttagcttggttaaaaatatcttcctgcacactattacgcttcattttatctaattccaataataaattactcaatgaaataatatgtttttgttgaaacttagaactatcagcccccaattgttgataaatctttatttcttttagccaacttgaaaaatatttgtcgtttcctcgttcagttaattcaccttcatctaggcaatctttaaatgccaaaaatttctccaaataaagttcagcaagttcggctaaaatttgttttcttttatttcgttttaatgaacactctaaatcttcataattatctaaatccaccgaattatttaatgcaatattttcaattaattgttcatcttttcggcttgttaccgtttgaataatttgctcttctctttcggataattgttcgattttacgttgatgttttgcaaattctaactttaagttatccaattctttttttgcattatcggattctctgataaaactttgataacttaacacagcaggtacaactgtacccgctgtgattaatacccccaaaagcgtaaacactgaagtcgctgcttcccaagcaccttccgctttatacttgttagaaacagcttcaatactaaacgctaataacgcagcagccagaatactgaccaccgcccaaaaatgacttttattagattccacgttaattagtatccctgttcgctgagtttacgataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaccatttgaatgcttgatgatagttttgtttaacaccatccccttctttatacattaaacctaaaatagcttgagcctgagcaacaccttgctccgctaattccttaaaaagaggaaaagccacttgataattttcttgttcgatatattgatatgctctgttaaatttctcttctgcgtcttccgcatacacattcccaacgaagacaaaagagagtaataaggtagagagtagggttttacgaagtgtcattttgttttccttttgactatggttttaagacgacaaaattgtacaaaaaaaaaacaaaatgcaatcaagatgtaatcagcggttttttgttggaatttatgacaaacgatggatttttaggcagttcttggagttggttccggcattgttccctacacctattctcttaaaatgggctttggggcgaatgcgatataatatctttcttattcctcaacttttatgaataaactcagatttccttaagaaatttatgctaaactgcgcatcgttttaatccgatcataactataaaaggatataaaaatgtctatgttattaaacctgtatcgtaaagcattgaacctaccgctttcgctgttagtgaaaacacgttcaattcctacagatcctgtgaatgaattagggctgaagttagatcaacctattgtgtatgtgttgccctacacctcacaaacggatctgttaattttgcaaaaaaactgtcaagccctgaacctgcctgatccgctggtaaataatgatattcaaggggtatctttgcctcgttttgtctttttagatgaagggcgtcgtttctttaaatccaaaggggcgaaaagtgaaacagagttggttttctatcgttatttagatttaaaccgtaatgatgagcagttagacattcaagtggtgcctgtttctgtgctgtggggacgcgcaccgggtaaagagaaaggtttgccagtattacgtctgctgggaactttccaacgcttagtgacaatgctttggtttgggcgtgataattttatccgtttttcacaagcggtttctttacgctatatgattaccaatcacggaaccgatgaaaatctggctcaaaaattggctcgtgtggcaaaaatgcactttgctaaacagcgttattcggcaacaggccctcagttgcctgatcgtcaagcgatgttcaataagttactgcaatcccctgcaattttggctgcgattgaagatgaagcgaaaaaaccaaaaagttcgcttgaaaaagctcgcaaagaagctgagaaaattctggatgaaatcgctgcaaatgttcgtcacgacagcttaagaagcgcagatcgtgtgttaagttggttgtggaataaactctatcaagggatcaacgtgcaatatgcagagcgtgtgcgtaaattggcattagaaggacacgagttagtatatgtgccgtgccaccgtagccatatggactatctgcttctctcttatattctgtatcatcaaggcttagtgccgccacatattgctgctgggatcaacctaaacttctggcctgcaggtcctatttttagaagttggggggcgttctttattcgtcgtactttcaagggcaatcgtctgtattctacgattttccgtgaataccttgcagagctgttctaccgtggttattccgtagaatactttattgagggcggtcgctcacgcacagggcgcttgcttgatccaaaaacaggaatgatgtcgatgacgttacaagcattgcaacgtggcttaactcgcccgatcagcattgtgcctgtttatattggttatgaacacgttttagaagtagatacttacgctaaagaattacgaggtgcagagaaagagaaagagaatgctggcttggtgttacgtgtgattaagaaactgaaaaaactagggcaaggctatgtgaattttggcgaacctattccacttaatcactatctcaatcagtattttcctgaatggaaagaaccgcttacagatgaaaatggtcgtccaaaatggttaaatagtgccgttgaagcggtatctaaacaagtgatggtgcatattaataatgccgccgcagtcaatgcaaaaaatctcattggctctgtgttgcttgcttcacgccaacgttctttaacgcgtgaacagcttattgagcaggttgaaagctatatgcaactgttcaaaaatgtaccttatacagcggaagtcactttgccaacggatacagctgaagcgatgttagatcacgttattaatttacctcgttcaggtgttatctcagaaaaagacaactttggtgaaattatccgtttagatcgtcaatctgcagtattaatgacctattatcgcaataacattcagcatttatttgttttgccatcattggtcgcaagtattgtgttacatcacgagacggtatctaaagatttgattatccagagtgtaaatcgcatttatccgttcttacaagcagaactctttatgcactttaaagcagaggaagttcgtgggcatattgaggcaattttagcggaatttgttgctcaaaatctgattaaaaatgaaagcgatatgtttgtgattaaccgccaacgtatccgttcattacagctacactcttcaggtgtccgtgagttattacaacgttattacatcagcttgagtattttgattgagcaacctgaaattagtcgaaatgagcttgaacaagaaagccgttcaattgcacaacgcctgtctgtgctacacggtattaatgctccagagttctttgataaagcattgttctcgacctttagtgccacattgaaagaacaggggtattttgatgaagaaggggatacgatcgtatcaaaagttcaatctaccgaagagttgattagaggattaatctctgttgaaatccaacatactgttcaaggagcgatggtcaagttggaagaggtaaataatatataaatatagggcgctttctaattaaatattgtaggaatacttgatgagttgtgttcctacatttcttttcttgtggaacagctacaaaatataaaattttttgcaataaccgaccgcttctatcattttttccttgtaattcctgcaaattttgctacattccacaggttatttttcttgtttaaaaggtcaaaaaatgaaccaacaacttgagttaatcaaatcttccattaaatctattcctgactatccaaaagcaggcattatcttccgtgatattacttctttattagaagtgcctgccgcattccaagcctctgttgatgcaattgtggctgagtttaaagataaagggatcaccaaaattgtgggggctgaatctcgtggatttatctttggtgcgccagtggcattagctttaggtgtgccttttgtacttgtgcgcaaaccgaaaaaattacctcgtgcggtaatttcgcaatcttatgcccttgagtacggcgaagataccttagagatccatacagactctgttcaagctggggataatgtgcttgtcattgatgatttacttgcaacaggcggtacggtggaagcaacagtacaacttattcgccgtttaggtggtacagttgagaatgcagcctttgtgatttggttgcctgatcttgacggtaaagaacgcttagagaaaatcggtgtcaattcttataccttagtgagctttgaaggtcactaatcttatatttctccctttgcaatcccccctttgtaaaaggggggttaggggggatttcaagagctacgcaacatctaaagaggtcaaatgtcctatcaagttctagcacgcaaatggcgaccacagcggtttagcgaagtggtcgggcaacaacacgttttatccgctctcgaaaatggtttgcgagaagggcggttacatcacgcttatcttttttcgggaacgcgtggcgtagggaaaacgtcaattgctcgtctgtttgcgaaaggcttgaactgtgaaacggggatcagtgctgatccctgtggtcaatgtgcgaactgtaaagccattgaagaagggcgatttatcgatctgatcgaaattgacgcggcttcacgcacgaaggtcgaagatacccgtgaattgctcgacaatgtgcaatacaaaccaaccgtcggacgttttaaggtctatttgattgacgaagtgcatatgctttctcgtcacagcttcaatgcgttattaaaaacccttgaagaaccgcctgaatatgtcaaattcttacttgcgaccacggatccgcaaaaactgccgattaccattctttctcgttgtatgcagttccatttgcgtgcgttggaacaatcgcaaattcagcaacaccttgaatttatcttaacccaagagcaaattccctacgaattgtcagcacttgctaaactagcaaaagcggcacaaggcagtattcgtgatgcgttgagcttaaccgatcaggcgattgccgttagcaatgcgaatatcaccttgccgattgtaagccagatgctcggcttaattgacgatcatcaaccgttagaattggtgcaagcccttgcgaatgccgacggtgaaaaagcaatggcagtgattcagtccgtggcggaaaaaggtgtcgattggcaacaactgttaagcgatacggcagaaaccttgcaccaaatcgcgatgttgcagttgttgaaacaccctcatcaagaagaaaccccactgcattttttagcaaaacagatctcgccagaagatgtgcagtttttctatcaagtaatgcttacaggcaaaaaagagttgccttttgcccctgagcaacgttcaggcgtggaaatgactattttaagagccttggctttccaccctaaaaatattgcaaccacgataaaagttgctacacctacaccaacaacgcccgttgcacctgtgcaatcgccaaatagcattagccagttaagagaacgtttagctcaacagcaaaattcagctcaaactgtgacaacacaagcggtcaaaactgaacaacattttgcaaaaaatctctctcaaccaaccgcttccccaactgaaacgaatacagaaagcatatcgcctgccttaaaagcaatgcaagctcgtcagcaattaaaagcgaaacaagagcaacaagacgaaaaaaaaaagtctgatttaactcccattcaaccaccaaaaacgatgaataaaaagagcgttcagcaaggtttaatgaacctagtgaccgctcaagatcaacggcaacaaatagaagaaacacctcaaaaaaatatcgcttcacaaaatgatgaagactaccgttggacgtggcttaatcctgagttagaaaatcaagaggaagccccgaaaccttcagaaattaagcaagctatattgcaagagcgaacacctgagctagttaaaaaaacgattgagcttggttgtgaacgagatgaatggagccgaattgtaaacagtttaaaactgggcggagtttctcgtcagctcgctttaaacagctatttagaaagccataacaacaatcatcttttgttggttttaaaccccacaatggcacatttaaacagcaatgaagcgacccaaagtttatacaatgccctctcacaacaaggctttagtagtgaaatgcgaataggcgaaagtgatgagttccaaaccccattagaaattcgtcgagttatttttgaacagctcacgcaagaggctaaacaagcactacaagcggacgaaaagttaaaacttttacaacaagcctttgatgctcaaatggacgaagcaactattcgggcagtagcggagtagaaaatatgtacgcactcgaaataaaaaacctaatcaaacaatatccaacaggtgttcaagcccttaaaggcatagatctctgtgttgaacagggagacttttatgcattgcttgggcataatggtgctggcaagtccacgacgattggaattattagctcactagtgaataaaacaagtgggacaataaaagtgtttggctacgatcttgataaacaaaaaattcaattaaaacaacagattggattagttccccaagagtttaatttcaatcagtttgaaaaagtgatcgacgttttaattaaccaagcaggattttatggcattaagcgtagtcaagccttaatccaagcggaaatttggttgaaaaaattagacttatgggaaaaacgtgatcattttacccgtgaattatcaggcggtatgaaacgccgagtgatgattgcccgtgcattaatgcataaccctaaactgctgattttagatgaaccaacagcaggggtagatattgaacttcgccgtagtttgtgggattttttgcgagagcttaatcagcaagggacaactattattctgactacgcactatttagaagaagcggaaactctgtgtcgtaatatcggaattattcagcaagggcaaatcatcgagaatacctcaatgaaagcgttattggcaaaactcgaaacggagatctttttgctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagatttaagtgaaaaccgaccgcttgttattgacggttatccgtttaaatgggtagatgaaaccactatcgaagtagaagtaaaccgaaaacaagggttaaacaacttattccaacagcttagttcacaacatattgaagtgttaagtatgcgaaataagtccaaccgcttggaagagttgtttatgcaattaaaatagccaataaaattagataaacatatgatcggattttcaacactcgcaataaaagaaacaaaacgtgtcttacgcatttggcgacaaacattagtaccgccaattattacaacgacactctattttttaatcttcggtaaacttatcggacaccgtatcggtgagatgagcggtgtaagctatatgcaatttattgcccctgggttaataatgatgtcagcaattaccgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgtcagcaattaccgcttcttacaccaatacagcttcatcatttttcctaagcaaatttgttcgcaacattgaagagttgcttgtgtcaccgctatctacccatacgattatttggggatatgtggcaggcagtataatgcgaggtgtaatggtcggtatccttgtgacagcggtgacattgtgctttgtttcttatcaaatatactcttggggcatcattatccttacgatgttgatgacgactattgcctttgctctagggggattgattaatgccgtatttgcaaaaacttttgatgacattggcattatcccaacctttatactaacccccttaacctatcttggcggtgtgttttattccattagcttattgcctgaattttggcaacaagtgtcccagtttaacccgattgtttatatgatcagcggttttcgctatggttttttaggtattagtgatgtgtcgatctactatacttttgcagtgttaatcttatttatcctggcgctttacacttgggcttatcgcttaattgagagaggggttgggttaaggtcttaagaaccaacaagacagaaactcaaaataatctgttgtttatcttctctctttatgaacaaccttgacaagaccgataaaaagagcgataaatggcactaaaaaaaggaaggattattatgccaagtgttattttaaccaataccgttgcgagtattacagaactaaagacaaatccaatggcgacattcaatgcggcaggcggtgaggcaattgcaattttaaaccgaaatgaacccgctttttattgtgtaccaccgcatatttatgaatatctcattgagcttgctgatgatgcagaattagcaaaattagtggaagaacgccaacacgaaaaaagctacaaagtggatttagcggatttattaaaatgagctataccattgaatttatcccatcagcagaaaaagagttccgtaaactaagcttagatttaagaaaacaatttatcgaaaaacttaaagaaagagctgaaaatccgcgtgtagaaagtgctaaacttcgtggaatgaaagattgttataaaatcaaattgcgtaatgcaggctatcgtttggtatatcaagtgattgatgaacgtattgtaatcaaagtggttgcacagggaaaaagggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacgtttaccaaaaagtacaattacgtttataaaaatataatttgaaaccataaaaaaacccgataccaaaaaacagtatcgggggaggtcttacctaaggaaatgaaaaataaaactagcacattatgcgtattctaagactaccccaataaaatttagttcaataaaatgctaaaaaatttaaaaaaattatatcttattgaaataattaataaattaatgagataacgaggcgaataaatggttcaaaccaccttttttatttacgattacgaaagttttggtgtcgatcctgctacagatcgtcctgcacaatttgcagggatccgcaccgatagcgatttcaacattatcggtgaacccgtgatgttctactgccaacaaacagaagattatttgccttcaccagaagctgtgatggtaacagggattacaccacagctttgtaatcaacaagggctacctgaacctgaatttgccgctcgtattcacgccgaatttagccaacctaacacctgcgtgatgggatataacaacattcgctatgatgatgaaatgacccgttatacctttttccgcaattttttcgatccttatgaatatagctggaaaaacggcaattctcgttgggatcttcttgatgttgtgcgtgcctgttatgctttacgtccagaagggatagaatgggcgtatgatgatgaaggtatgccgagctttaaattagaaaatttgaccaaagcaaatggcattgctcacgacaacgctcacgatgcaatggctgatgtgtatgctaccattgcaatggcaaagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgtttctggaatgttaggcaactatcgaggtaacaccgcttgggttgtgccattggcttggcacccgactaatcgaaacgcagtgattgtatgtgatctatcggggaatataaacgacctattgaatgagccaagcgaaatattgcgtgaacgcctttataccaaaaaagcagaattagaagctcaagggctttatactgttccactaaaacttgtgcatattaataaatgcccgattttagctccagccaaaacgttactgcctgaaaatgcaacacgtttaggcattgatcgtctagcctgtttagaaaatttaaaacggctaaaatcacaaaaaaaccttgtgcgagaaaaggttctcgatatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctgaagaaagaaactatccaacgtcaaataatatagaaaccacgttatacgatggcttttttgaacctgcagataaaaacaatatggcaatcttacgaagcctaaaacctgaagagcttgcacatcacggtttgaaatttagcgatcctagaattgagcctctgcttttccattatcgagcaagacactacgcagaaaccttaacacgcgcagaacaagtacgttggcaaaagtattgctatcaacaacttgaagcaaaagcagaggcctttgaacaagcacttgatctgttatcggctcaatatcacgataattctgaaaagataaaattattgacggatctcaccgcttacgcagcacaattaatgcagcctaaagccaccaaatccgtcaattcaccagcttcagagctattagtatcggaattaaatcaacttgctgatcaagggctgagtaaagcggataaattaaaagcgattggggctttgcttaataaaaaataaacttattctcgctatagacaatggctaggcaaacgattactatcactccaatttttacaaacacgacgataaggaaaacgatatgaataaaacattaattgctcttgctcttgtggctttttctgcaacttcttttgcaacaacaaacggaaaacaagcagtcgcttctgaggaaacaaaagctgcaaatgccctcgtattacaaacagacttcggtttaaaagatggtgcagtatctgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcaaggggtggcttttggggttgatcgcgagttaaaaatgtttgatttaactcacgaaattcctgcatataatatttgggaagcctcttatcgtttataccaaaccgcaacctattggcctgctggcaccgtttttgttagcgttgtcgatccaggcgttggcacagatcgtaaatcggtcgtattaaaaactaaaacaggacactattttgtaacccctgataatggcacattaacgttagtggctgaatttttagggattgagagcattcgtgaaattgatgaaacaaaacaccgcttggaaggttctgaaaaatcttatactttccacggacgcgatgtctatgcttatacaggagcaaaattagcgtctgggcagatccgttttgaagaagtcggtgcagagttacctgccaaagtcaccgaaattagctaccaaaaacctgctattgaagaaggtacattaaaaggcaacattcctgtactagatattcaatatggaaatgtctggacaaatatcagccacgaattacttgagcaatcaggtattcaaaaagatggtaaggtctgtgttgaaatcaaagaaacaacggcagatgaggtcaaagtccgttatagtggctcaatgccatataagagcagttttggtgatgttgaagaaggcagaccattgatgtacctcaatagtttattgaatgtttcttttgccttaaatatggataattttgcgggaaaatacaaaattaaatcaggggcagaatggtctgtttctgtgaaatcttgtgaaaaacaacaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatggttggactaattaaggataattaaatgaaatatgatttacatagccatagcactgcgtccgacggcgtgcttacccccacggaactcgttaaacgagcggtagaacaaaatgtaacaatgctagccttaaccgatcacgataccgtcgcaggtatcaccgaagcgaaaatgtttgcccaaaaccaaccgcttacctttatcagtggtgtagaaatttctgtgttatgggaagggaaaagccttcacctcactgccttaaatattgacgaaacccaccctgctatcgtcaatttacttgctagccaaaaacaattacgccaagaacgtgccgaattgattggcgaaaagctctccaaagcaggtatccctaacgcatatcaaggggcaaaagccattgcaagcggtgaagttactcgcgctcactacgcccgttttcttgtggcagaaggctatgcacgcaatgatgaacacgccttcaaacgctatctagggatcggcaaaacagcttatgtaaagcccgtatggtgcagcaccgaagaagccatcgcagcgacgcaccaagctggtggcgttatctgttttgcacacccattacgctataaattaacagcgaaatggatccgccgttttattgaagagtttaaacaggctggcggagatggcatagaggtaacgggagccgcccaaacgccagaccagcgtcagcttcttgctcgttgggcaaaagagtttgatctctatgcctctgtcggctcagatttccactacccgacaggctgggttgagttagggaaggatttgatattaccttcaagctgtaagccgatttgggcattgtttagttaattgatttatattaggtgaagtgcatagtaggaaatgattttaactcaaagtgtgtgtactcacattgattgatgttgtatctactatgctatttatttaatcaattttataaactgtttttttcccctcgagccaaactaatcaccccagaacgaacgatttcaataattgttgtttctgctttcactgtttcaataaaagcattgagtttatcactagcaccagagagctgaatggtatattgttttggcgtaatgtccacgatttgtccacggaaaatgtcaaccattcgcttaatttcatctcgtgtactacctacagctcgaacttttagtagaagtacttctcgctcaatatgttcgcaatggctaagatttgtcactttgaatatatcaattagcttatgcagttgtttttcgatctgctccaagacttgttcatcaccttgtgccacaatggtcattcgagataaactcggatcatccgttggggcaaccgtaagactttcaatattaaaaccacgttgagagaatagcccaacgacacgggataaagctcccgattcattttctaataggacggataatattctacgcatctgttctctccgttttacttaacatcatatctttcattgattcaccacgaatttgcattgggtaaacgtgttctgtttcatctactaacacatcaacaaaaacaagtttatctttaattgcaaaggcttgtgctaatttttcctctaattcatcaggggtgttaatttgaataccgacgtgtccataagcttctgccagtttgacaaagtcaggtagtgagttcatataagattgagaatggcgacctgcataaataatatcctgccactgtttcaccatacctaagaagcggttgtttaaactcacaatcaccacaggggtatcatattgttttgctgtagaaagttcttgaatattcatttgaatactgccgtcacctgtgacacaaacaaccgttgcttcagggtgtgcaaatttcactcccatagccgcaggtaagccaaagcccattgtgcctaaaccaccagagttaatccaacgacgcggtttatcgaaaggataatgtaacgcagcaaacatttgatgttgtcctacatcagaagcaatataggcatcgccatttgttaatttataaatggtttgaataacctgttgaggtttaatcacatcactttgctcaaaacgtaaacattgacgagctttccactcattaatttgttgccaccaagcggtcagatctgattgaccttttgccagattttcttcacctaacaatgctaaaaattcttctaatacaaattttgcatcgccgacaatgggaatatatgcagggacggttttagaaatagaggtaggatcaatatcaatgtggatcactttagcatttgggcagtattttgcgagattattagtagtacgatcatcaaaacgcacaccgatacccaaaattaaatcactttcgtgcattgcattgttagcttcataggtaccgtgcatacctaacatacctaggaattgcttatctgtacttggatatgctcctaatcccattagagaacttgtgacaggtagatttaatttctgagcaaattcgatcaactctttatttgactccgaaatcactgcaccaccacccacaaaaagtacaggttttttagccactaagatcgcttttaatgccttcttaatttgccctttgtgtccttgtaccgtggggttgtaagaacgtaatgatacagaatcagggtagtggtaactgaatttatttgctggatttaccatatcctttggcacatcaataacgacagggccagggcgacctgttgaagcgatataaaatgctttttttatgatctcaggaatttcttctggattggtgacgaggaaactatgtttaaccacagggcgagaaataccaaccatatcacattcttggaaagcatcggttccgataaggcttgaaggcacttgtcctgaaaaaacaaccagaggaatggaatctgtgtaggcagttgcaatccctgtgatcgcatttgttgctccagggccagatgtgactaatacacaaccgactttacctgtagaacgtgcatagccatcagccatatgtacagccgcttgttcgtggcgaaccagaacgtgtttgattccacctaaggtgtgaattgcatcataaatatcaagaactgagccacctgggtaaccaaaaacgtattccacgccttcgtcacgcaaggattgcacaatcatttccgctcctgagagttttttcattgaatcctccaacaaaattaacataaggtttacaccataaaaacaatgttgggcattttgcaaaaaatctgaccgcttgtctagccattaaaaacaatgttttctttaatttttagatttaaattctaaaaaataataaaaatttattttttataaaaaaatgttgttcttttatttatttttattaatataacttatattttataaattttnnnnnnnnnnnnnnnnnnnnnnnnnnnnnnnnnnnnnnnnnnnnnnnnnnnnnnnnnnnnnnnnnnnnnnnnnnnnnattttcaaatattgaggtatttatatgcaaaactacaacattgccgtgttaagtggtgacgggattggccctgagattatggctcaagcgattaaagtgcttgatactgttcaacaaaagtacgggtttaaattaaattataactattatgatattggtggcgttgccattgataatcacggaaaagcattaccagaaagcacattaaaagggtgtgaagaagccgacgctattttgtttggctctgtaggcggtccaaaatgggaacatcttccaccaaatgagcaaccagagcgtggtgctttgttaccacttcgtaaacactttgcattattctgcaatcttcgccctgctacactttataaaggcttagaacaattttgcccattgcgtgcggacattgcagcaaaaggctttgatatggtaacagtccgtgaattaacgggtggtatctattttgggcagcctaaaggtcgtgaaggcgagggagaaaatgagaaagcttttgatacggaagtttatcaccgttatgaaattgaacgcattgcaaaagtggcatttgaaacggcaatgaaacgcaccaaacatgttacttccgtcgataaagccaatgtgttaatgagttcaatcctttggcgtgaaaccgtaaatgaagtagcaaaacaatatcctgaagtgaagctggatcatatctatattgacaatgcaacaatgcagttaatcaagcaacctgatttctttgatgtgttgctttgctctaatatctttggcgatattatttctgacgagtgtgcgatgattactggctctatgggaatgctaccttctgcgagtttaaatgaaaaaggatttggtttatacgaaccagcgggtggttcagcgccagatattgcaggtaaaaatattgctaacccaatcgcacaaattctttctgcagcgatgatgttacgtcatagttttggtttggaagaatctgcgaaagcgattgaaaatgcggttcaaaaagtattagccgagggttaccgcacggcagatcttgctgatcatactacgatgcccgtaactacctcggagatgggaaatttgatcgaacaatatattggataaggttataccattttatttatggttaaaaaggtacattagttcttctaaaaacagtatccaaagtcacgataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgttgctaatatttattttgtctattacaccaataaattacatcttttattaaaaaaggttaaagcttcatcaggctttaacctttttactatgtcgctatgtcttggctactgcactatcaaaaaaataagcaacccttaccgagttgcttattaattttaccgctacatcaggaattaaagtttaatccttagcatatttcgcttcatcaaactctctcaacggcttatgctcactacctaaataggtatagatcacaggcaatacaaacagtgtaaagagtgtaccgatagctaaacctgcgacaatcaccataccaatactaaagcgagcaatcgcacctgcccctgaagcataaagcagaggaataagacctgcgatcatcgcggcagtcgtcatcataatcggacgcaagcggatagttgcagcgtggaaaatagcatcacggcgagattttccgtgaagcaactgctcttcttttgccacttcacacatcaagataccgtgttttgttatcaagcctacgagggtgattaagccgacttgagaataaatattcaaggttgcacctgatactttcataatgcccaaaatattcatcaccaataatgcaccactaattgctaacggaacagaaactaaaatcaccaacggatcacgccacgattcaaactgaatagctaagacgatataaatcatcacaactgccagcacaaaggtaaacattaatgcgttaccctcttggatatattgacgagattcagctttaaaatcatattgatagcctgatggcaaggagcgagctaactcagcttcagcccattttacggcatcaccaatagaacccgacaccacaccgccaattgttgccgagttaagctggttcattcggctgagggaagctggttctgtacttaattccattgtgacaaaagaacccaatgggatagattgtccgctcgctgttgtcacatagtagttcattaaattttctggatttaatcggtcatttctcaccgcttgcgatacaatcggataagctctggaatcaatatcaacacgagtaactatagcccccgacaagaacgaacctaaagtgccactcacctgttgcatcgttacgccataagtccccattttttcacggtcaaacttcatcttcatcgttgccgtgttaaatttaaggtctaagttagcgaagaaaaattgccctgacgcttgtgctttggctaaaatttcactggcgacttctgcaagtttttcatagctatctgcagtcgtaataaccagtgagaacggcagcccactttcacctgtctgaatttcagggaaagcaacggcgttaatatccataccaaccacttgttttgccatacctgcaacaatgtctttcacttcaaactgcgatttgctacgttcagaccaatcttttaaagagataatcgacaatgaactgttgccaccgttaaagcctgcaatcgacattgcgccgtgaacctcaggcaatttaaccactttctcattaaaaggtttcatcacttcctgcgtatagtccaagttagtatttgcaggaccagatccaaaagcaaccacaacaccacggtcttcagaaggtgcaacctcactagacaatgaagtaaacaagaacggtaagctcgcaaaaatagcaatcgcaaagaacagcataaagccacgcactgccatcactgctgaaagcatattttgataacagcttgtcatcttatctaacatagcgtgaatgcatttgactaaacgcccttcttcaccctctttatgttcttttaacacacggctagacatcatcggcgaaagggttaatgctgcaatccccgaaataaatacagcaccagcaagggttaaagcaaactctttaaacagagatcctgtaaccccttccattaatgccatcggtgaatataccgccgcaagagtaatggtcattgaaatgacaggcaatgcaatctcacgcgtcccaataattgccgcatcgaaaggcgttttaccctctttaacgtgacgctctacattttccaataccacaatcgcatcatctaccaccaaaccaattgccaaaatcaatcctagcaaggtgagcaagttgatcgagaacccaagcatctgtaataagaataacaccccaatcaatgaaatcgggatagtgataacagggataatcatcgcacggagtgaacctaagaataggataatcacaataagcacaatgattgttgcttcaccaatggttttaattacctcagaaatagagctattaatcgcaatagtactgtcatacaaaatctcagctttaatggaagcgggcagattcttctcaatttgtgcaaataacggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaataacggatagatatttttggcaacggttaatttgtttgccgttgctgcagactcaacagcaatcaccactgcatctttgccatttgctgtagctcgagcattatctgaagatttattcagttcaacggtcgcaatatcttttaacttaatttgcataccatctgctttggttgccacagtaatatttgccagctcttctaccgttggagttgtcgataacaccttgtttttatagacagtgtaataaccatttgcactgcctgccgccgtcgaaaggttatttgcacttaatgccgataacacattcgcacctgaaaggttatagccagccattctatctggatctaaccaaatgcgtaagccaaaggttgaaccaccaaagataccaacgctagacaccccattgatcgtaaaaaattgcggtttcaccacgcgatttaggtagtccgtaacttgtggagatgaaagatcatcagaggtaaaacgaatatacataaacgcatcatttgatcccgatgatacgctgatcgcaggatcatcaatgccactaggcaagcttccacgaattgcatttactttagaagaaatatccgataacgcctcttgaggattggtatttaacttcatctttgccgttaccgtcgtagtacttggtgaacttgatgaagtcatatagtcgatgttatctgcctgtgcaacagcttcttcaatttgtgacgtaacaagtgcttgcattaaacttgcatctgcacccgcataattaacactcacagtaacaattgagatcgtcatctcaggatattcacgcacttgtagcttgctaatagactgtaagcctaagattgtaatcaataggctaatacagatagcaagtacggggcgtttgataaaaatgtcggtaaatttcacagcttaccccattacagttttgtttttgtcgctggtgcaataaccccaacaggttgtacatcagaaatttgaattaaggcgttattttttaaacgttgtaagccaccagtgacaattacatcaccggcttttaagcctttgctcaaatgagaatagactccactgcgttcagccgtcgtaacttccatctgtttagcacgatagattttattgatgtctaaacttttgttcatttcagccattttagtcactttttccttatcttcatcagataatggttgaagcacataaacagtttcgccatacattgtataagtaaccgcaatttgtggcacaacaacctgatcgtataaggttggtaatgcaacatttaagcgagcaaacatacctgaaagcaacttatcttgcccttctgtgaccactgcttcaagattaatcaaaccagttgatgtatccaccgcaggatcgatagcggtaattttcgcagggaaagtacgagcaggtagagcatcaatggttgcggtcactttttgcccaacaaaaatatcttctaagttagtctgaggtaaggtaaaacgaattttcatcgcagactgatcttccacacgcacaattcctgtgcccatcgtcacatattgccctacattcacattcacaatacccgcttcaccgtcgaaaggcgcataaatttgacgacgctcaatctgagcttttgtcgcctcaatagtcgccacaagttgctcataagttgctttggcattatcaaattccgcttttgaagcactgcttgacgctactaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactgcttgacgctactaagttacgatagcgattatagtttgctctcgctgtcgataactgagcttctgtcgctttcaaactggcttgttccgcactgctatcaatttcaactaatagctgaccttttttcactttatcgccagacttcaccaaaactttagtgaccgtgccagccgcctgtgaacttaacatagccccttgattcggacgaatagatccnnnnnnnnnnnnnnnnnnnnnnnnnnnnnnnnnnnnnnnngtcatcactgttacattgctcacaggctcaggcatattcgccgcagcttcagcctttttcatcgaaataaactgttgcataccaacaacaccaccaaacacgataagcacaaccaataaggtcacaacaatagcaaactgcttacccttcgttgtctttttcatatttattatcatattttctccatatcaattttgattaaatcgtaatcgctttccaagtacggataatcacttcttcaagcatctcttgagcataaggttgatttaacattaactgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatattagggttatccaacataaactgccaaattgcattccacaattttttatattgctcaaacagaggcaaatcaggatcatattcccgatctaccgcagaatgaaacgtattaaacaaatacaacacaagctgattaagcaaagtctctttatccttaaaataaagatagatcgtacccacagataccccagcttcttttgcnnnnnnnnnnnnnnnnnnnnnnnnnnnnncttcttttgccatcaacctatctgttgcattgagaatacgtattgccacctcattttgaggaaaaatatccttaaacataaaaacaagtcaagttactgaacgttcgttcattttactgagaaaaaaagattttcgcaaaatctaaagttcaagttttgtaaataatggatttacgcaaacgattgcgttataatttaaccgaaaatattccacagatcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaagaggggagatcgatgattaacgttcaatcaatacacaaaggaacccataatggctcatcgtccaatccaacaagtattattaagtgtgtctgacaaaacaggcattgtcgaatttgctcaaggcttagttcaacgtggtgtaaaactactttcaaccggcggaacagcaaaattactcgcagacaacggtttacctgtaaccgaagtatcggactacacaggcttcccagaaatgatggacggacgtgttaaaaccctacacccgaaagtacacggtgggatcttaggtcgccgaggcacagacgatgaaattatggcacaacacaacattgaacgtattgatatggttgtggttaatctctacccctttgccgccaccgttgccaaaccaaactgcacccttgaagatgcggtcgaaaatatcgacatcggtgggccaacaatggtgcgttctgcagcgaaaaatcataaagatgtagcgattgtcgtcaataacaacgactttaacgctattcttgctgaaatggatcaacaccaaaactcactcaccttagaaacccgtttcaaccttgcaattaaagcctttgaacacaccgctcaatacgacgcaatgatcgccaactacttcggacaaaaagtaccaccatatcaaggtgctgaggaagaagatattacccaagtgtgcggacagttcccacgcacattaaacttaaatttcacccgtaaacagacaatgcgttacggtgaaaacagccaccaaaacgccgcattctatgttgaaaacgaactgaaagaagcgtctgtagcaaccgcagttcaactacaaggcaaagccctttcttacaacaacattgctgatactgacgcagcccttgaatgtgttaaagaatttaacgagccagcttgtgtgatcgttaaacacgccaacccttgcggtgttgcccttggcaaagatattttagaagcctataaccgagcctaccaaacagacccaacgtctgcctttggtggcattatcgcctttaaccgtgaattagatggcgaaacggcacaaacgattgcagatcgccagtttgttgaagtgatcatcgccccaatcatctctgaagcagccaaagaagccttagcgaaaaagaaaaacgtgcgtgtattagcgtgtggcgaatttagcgaagcacaaccacgtttagacttcaaacgtgtcaatggtggcttattagttcaagatgccgatcaagggcaagttgctgttgaagatttacaatttgtgtctgaacgcaaaccaacccaagaagaattagacgatttactcttctgctggaaagtggcgaaatacgtcaaatccaatgcgattgtctatgccaaaaacaaacaaacgattggtatcggcgcaggacaaatgagccgagtttattcagcgaaaatcgcagggatcaaagcggaagacgaaggcttacaagtggcaggctgtgtaatggcatctgatgccttctttccattccgtgacggcattgatgccgcggcaaaagtcggcattacttgcgttatccacccaggtggctcaatgcgagatcaagaagtgatcgacgccgccaacgaacacggaatggcaatggtactaacgggaatgcgccacttccgtcattgaaatccctatcagccttttgggaaccttcctccgtaagcgggggaaggtatgaaaacaaatatattctgaagatatttacgatgtaattcgctcaagcccagcttcaagatcagcaatcaaatcttccacatcttccaaaccaatatgaacacgaatgagtgtccctgttaatttacgttcaatggctgggcgaatacgttcaatctctttaggttgatttgccaaaattaacgactcaaatccgccccaagaatatgccattgagaaaatctcaaaatggtcgagaaaattcgcaagctcttcattagataaagttttacaaagttcaaaggaaaatagaccgcttgaacctttaaaatcacgtttaaaatatgcgttcccagggcaacttggcagcgctgggtgataaactgcttttacttcaggacgttgagccagccattgagcaacgataagactattttcttcgtgttgttttaagcgaatgcccaaagtgcgtaagccacgagcggtaacataagcagaatccgcatcaaccatttgccccattaaataagagtgctctcgtagctgatcccaacagcgagtatttgaaaccgcagtaccaatcatcgtatccgaatgtcccacaaggtattttgttccagcttggatcgaaatatcaatgccgtgttcaagggctggaaaaagaatgcctgcagaccaagtattatcaatcataatcacaatttcaggatttattgctcttgccgtacgaacaatcgctggaatatcaggaacttccattgttaatgaacttggtgattcgagaaaaagcactttggtatttggctgaatgagcgttgcaatgccttctgcaattaatggatcatagaaagtggttgaaacgcccattttcttcaatacgatatgacaaaaatcttgcgttggttcataggctgccccagtcattagaacgtgatcgccttgttgtacaaaagataaaatcgcattactaaccgccgctgcaccgcaagggtaaaggtagcagcctgccccattttccagttcgcacattgcatcttgtagagcaaagtgggttagcgtaccacgtctgccgtaaaataaagcccctttatagcggtttttagtcgcttcttttttatctgcaacagagtcaaatacaagggaagaggctcgttgaataacgctatttacagaaccttgggtgtaacgtttttttcgccctgcgtgaacaagttgagttgctaagttgtgctttgtcatattgatgtccattttttatgttttgggtttacaaattcagtgcctttattttggtaagaaataccttctaattcaagtagataacgtttagcaggaagcccaccaccaaaaccagtaagtgcttgagtcttacctaacactcgatggcaaggtattaaaattgaaattggatttcgtccaactgcaccgccaacggctctaacggcgttaggattatttaactgcttggcaatatcgccgtagcttactgttttaccataaggaatctcaagcaatatttcccagactgcttgctgaaaagcagtaccctgagggtttaaaaaatccaactgacaaaatgctactttttcccctgaaaaatagcggtctaatacctgcactgttttgcaaaatagttgttgaatttcaccgcttgcctgttctgaacttttccattgttgaaggttaagtgtttgttgctcttgttcaaattcaatgccaagtaaacctgtttggtttgcaataagaagcaatctccccactggcgaatgataaaattgatagaagatctgaaatttcataggattatcctaaaacaaaaggcgtgccacttagtgtacacrcctcaggytgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaataatctgacrcgtrycacttagtgtacacgcctttgaggttacatcaaatgaaaattagaatttatagtttacgtttaagccgtaaaggttagcagttgatttaactttaaatttacccactgcannnnnnnnnnnnnnnnnnnnnnnnnnnnnnnnnnnnnnnnnnnnnnnnnnnnnntttttgctaccacgcaaatgtgcataagcgaggtcaacagataaattcggggtaaagcgataagttgcacctaaagtgtaccatgtacgatctgtatcagggattgagatagatggatgtgccacgcttgcactttcatcataagcaatacctgcacgtaatgttaatgcctcaatcacatcataagacacgcctaacgcaatgcgagagttattattgaacttcttatctttttgtaacaacactttaccgttgttatctgttgcacgaagttctcggaagctattccaatgtgtctttttatagctatattgtacagccaatttctcagtaagtttatgataacctgagatttcccaatatgctggtaactcaaggtttaagcgacctggaatttcaacattggcactttgagtacccacatatttccctttgaaacgtaaatccactggagaatggtatgcaacaccaagacggttgttttcattaatatcataggttaagcccacattccaacgaaagccccatttatcgccttttaatcgacttgctatcgctgtcggtgccataggatttaaagcaccaaaatggcgctctaatgttgcttttgcatgtactgcatttaagccagcaccaaagctaaatccgtagccaagatcataagcactgctgaagttatagtttaccgcactaagttttgttttacctgctaatacgccagcactatannnnnnnnnnaattctgattttaagccataattaacattaacaccgccacccatagcaaaacgctcagagattggggcaacaacatataaattagggacaattgcactaggaataatatcttttgcatttgcatctnnnnnnnnnnnnnnnnnnnnnnnnnnnnnnnnnnnnnnnnnnnnnnnnnnaaaagaaccttcaacatcaacattagcatcaacataaatcccacctgcagaaatttctacttgtttgaatttggtcattaatgctgggtttgttgccacaacagaagcattatctgcaactgccgcattaccagcatacgccatacctaagccagaagttgaaatttcagctaattggaacgctgctgcagaagcaccagctgcagaaaaagtaaagatagaagcaagagctgttttagtaaatttattcattaggtaatcctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaggtaaaatatgttcgaatgtaattcaagttcctgctgttctattgatgtgggaactattattgataacagtgattgtgctgtaaattttactcaactttacactactaaagcagaagctgaagacgctttagcatttttaaccagcaaagctcgatcaacagaatctgagccttgtgagattaccagtgaaattatttctacagaaaatggcttccaacttaccgcttgtttcaaatttagctaccaagttgaatcaatgatttttgagttgggaataagatagaaaaagcattagataaaactcacataaacagctaggcaattcggagcttaatatgaatgaaatcacaagtcttagccaattagatttaaatggcagttatagctatggcgattatttaaaatggaaatttcaagagcgcgttgaaattatcaaaggcaaaataatggcaatgtcgccagcgcctaatcgattacatcaacggatttcgatgaaattaacaaaagcattcttagatgtttttgatagtcatcagtgtgaattatatgttgcyccctttgatgttcgttttccagacagcaatggcaaaatcaaaacggtagtgcaacccgatttgtgtgtcatttgtgacccgaataaattggacgaaaaaggctgtattggcgcgccagatctaattgttgaaattctctcccctggtaattcaaaaagagagatgaaagacaaatacgaactctatcaagaacaaggcgtaagtgaatattggatagtccgccctgaagaacaacatatccaaatttatgtgctagaaaacggacgctacataggcgtgcaacctgtcgtggaaggcgatgtggttacatcaataaaatttccagcgttgagtttcgatactagcgggttgtatgagttgtgattgaaattaggggaatgtatacaaatatacaaaaagatttcccccatccgcccttcgggcaccttcccccgtaaacgggggaagtattaaaaaagtaatgtagtctgaagataaaaattcttcccccatttatgggggannnnnnnnnnnnnnnnnnngggggatgggggcatgtaaaggagataaatatgaaaaaagtagccattatcccagcaagagctggttcaaaaggaatcaaagataagaacctacaacttgttggaggaatatctctagttgggcgagccattttagccgctcaagaatcagaggcttttgacgaaattattgtaacctcagatggcgatagaattcttgctgaagcagaaaaatatggcgcaacagcatttcgccgccctgtagaattggctcaaagtgatactagaacaattgataccattttacattgtgtaacaacacttggattaacagaaggtatcactgcacacttccaaccaactagtccattacgttcaggtttggatattcgtaatgccatggaattattcttggcaggaaattgcaaatcagtcgtgtcagcatgtgaatgtgaacaccacccgtataaatctttcattttggacgaaaatcacaaaattctacctattaatcaattaagtgattttgaagctccacgtcagcaattacctaaagcttatagagcaaatggcgcaatttacatcaacgataccgcaagtttattaaaagaaaaaaatttctttattcccgaagtgaagttttatttaatgccaagttaccgctctattgatattgatacaacattggatctgcaacttgctgaaagtttggtaaacaatgaaagttattaaagatagtgcaatctatctatttggagagttagtttcaaaatcaattccttttcttttactgccctatttatctagaaaattaggtgtagaaggatttggagaactctcttattatcaaacatttttagcattatttgctatttttattggactaagccaagatggtgctgttgcccgctatttttatcgatatggaaaacgttctttagatttagtggtaacaacggggtatgcttatactattacgataggagctttaggactcatcgcctgttggatagcaaaatctgaaattatgttttatttagtattaagtagcatatttcaagtatttcttgcagtacaacttagtataaggcaatgtcaaaaacaagtgtttccttatacactgattcaattaggctcagcaataaccaatgcagtatttacagtattaatattggaaatctatgaaaccgcgttggtagaaaagcgtattatcgcagtactatgtagcaatatttttattgctgttctagcttatattatttataaacgaaaaacagcgactaaaatttttagcatcgcacaatataaactcgcattatggtatgtaattgctttcggatttccaatgatatttcatcacggaagtttctttataaaagggcaactagatagaatctttatttatcacagatttagcgaagctgatcttggtttgtatgcgatgggggcgcaaattgcgagtattttatctgtggttattttggcagtaaacaaagcattagttccttatttatttgaaagattaaaacaaggcaccgtaacattaaaacatttacaaaaatgggcaatgtattcattgtttattgtaccagtaccttcattgataacactattaattcctgaacaactctttttatggttgttaggcgaacagtttcagggagtgaaatactatgtcgtattattcttgctttcaacaagtttgattattccctatttgttcttagtaaattatttgttctatcacggaaaaacaaaacagatttcatattgctctgttttatcgacagggatttatttgattgcactaggtgggttaatgtttacggagattagctatataccttgggcgagtgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagaacaacaaattaagcgttatcaatataaaattggtgtaggcgacgtgttaaatgtgacagtgtgggatcacccagagttgacaacacctgcaggtgcttatcgttcagctgctgaatcaggtaaccaagtccatgccaatggaacgattttttacccttatgtnnnnnnnnnnnnnnnnnnnnnnnnnnnnnnnnnnnnnnnnnnngataaattggcaaaagctctttcagcctatgttaccgatcctcaaattgaagtgacagttgcagcatatcaatctaagaaagcttatgtaacaggggaaattaaaaatcctggccagcagtttttaactaatgttccgttaaccttgttagatgcagtgaataaagctggcggtttgtctgaaaatgctgactggcataatgtgactattactcgtcatggtaaagaggagaaagtctctttagcagaattgattcaatttggtaatttaacgcagaatcgtttgttatctgatggcgatgtggttcatattccacgcaatgatgcgaataaggtgtttattgtgggggaagtgtcaaaacctcagatgttgaaaattactcattatggtatgacgttaaccgaagcaattgctcagagtgggggaattgataaattatctgcagatgcaacgggtatttttgttattcgtggtcaacgtgatgtaaataagtcaacggtttcaaatgaagctgaaaaaacagataagattgcagatatttatcaattggatttgactaatgcaacttcctatgtattaggaacagagttttatttaaaaccttatgacattgtttatgtgacaacagcgccagcaactcgttggaatagagtgattgcccatgttgttccatcattatctggtttcaataatctaacagagtctatgttaagagtgaggaattggtaattaatgtttggaagtattttagttgtttgtatcggtaatatatgccgctcccccgtcggagaaaaattattaaaacaatattttcctgaaaagcgtattttttcagcaggtatttcagctgagcgtagccatttagttggaaaaggtgtagatccaacaatgcaacaagttgctatttctcgtggagtggatctttctgaacatcgttcacagcaattaacgtctgaactatgtaagaatgtagacttgattcttgtcatggaaaaaggtcatattgacttggttcgacaaatttcaccagaaagttctggaaaagtcatgttatttggtcattggttggatagcaataaagatattccagatccttatcgtcaaagtgaagatatgttccgagaggtttatgcattgattgaggatgcagcattgagatggaaattgaaactctaattttaaggcagttaaaagatgaatgaaaataatcatgatgaaattgatttagtaaagttgttgggggctttattagattataagtggtggatagctctttttacattgttggtgacgttatttggtgttgcttatgttttactagctccgcctgtttacactgcgaatgcttcaattcaagtagaaagtaaatcttcaagggggcttttaaacgatttcccaggaattttagagggtgaatcatcttcaagtactgaaattgcaattttaaaatcaagaatggttttatctaatactgttgagcaacttaatttaactacggtagttgaacctcaattctcgatcccttttcttagtaaaggtcttcatcgtttgatgggatatgaaccacaattgtcgctctctttatttgagcctaagaatcctcagatgaaagagatgattttggaggttggggagaatgctggagagttctcattatttttcgcagatgaaaaagttcttgaagggagcattgggaaaaagtatcaaacggaagatttttcgtttgcgatttctgaattagaggctaagccaggacaattatttaaaattaaaaagaatgatgtgttgttagcaattaactctttacaaaaacaaatttcggtaacagagagtgctaagcagacaggcattattgaaatttctattaatggagagaataaagctcaaattaagaagatagtaaagagtgtatctgaaaattatttgctgcaaaatattgttcgtgattctgcagaagcgtctaagagtttagagtttttgtctaaacaattaccagaacttaaagctcgtttggcagagtctgagaataatttgaatgaattccgcttaaaaaatgaatcagtagatctcagtctagaagctaaatcagcattagatactatagttcagttagaagcagatttaaatgagttaacattaaaggagagtgaaatttctcagaaattcactcgaaatcaccctgcttatgttgctttgattgataagcgtaaagtattaaatgaggaaaaaattcgtttaaataaacaagtagaacgtttacctaatactcaaaaagaggttattcggttaactcgagatttggaggtaaaccagcaaatttatattcaattgttgaataaaatgcaagagttagaaattgttaaggctagtacggtaggaaatgttcgtattttagatgaggcgcaagttttgcctaatgccgtttcacctagaaaaatgattgtggttgcctcggcatttatgttaggacttatctttgcctcagttactgcgatagcgaaaacgctactgcatagaggtattgagggaacatctgaattagatgtgttaggcttgccaacgtatgctacgattccatattcaaatgaacagcctattttttctaagcataaggttcagcattttaaattattgtcggagtcaacgcctacagatccagcagttgaggctttgcgtagtttgcgtacaagtttgcattttgcaatgttagaagctaaaaataatatattaatgatttcgggagcttctccgtctgtgggaaaaagttttatttcaaccaatttggctaatgttcttgctaaagctgggcacaaggtgttgttaattgatgcagatttaagaaggagttatttgcgtcgattattaggtttagcaaaaggggttggattgagtgatgtgattgcacagcagattccttttgaacaagtgattcaacattatgataattttgatattattgttaaaggagaaactccaccaaatccatctgaattactatctaatgctcgttttcaggcactattagaatgggcggcaaaagaatatgatttagtgatagtggatacagcgcctattttggctgttacagatgcagctattattggtaggtatgcaggaacatctttacttgttgggcgttttggtgaaactacacttaaagaagttggattagctaaagaacgttttgaacgtgcaggggtctttattaaaggttttattttgaatggtataaaacgtaaggcttctaatcgttatgattattatcaatatgattacaaatagttgctaactttgtaatcttgatgtaagcggtgggattttaactatggttataaaaatagtttagaatttcgccgcttagtgttttatctaaactttaaaataatgtttatgtgaataagattagcaaattgattaaaaaaaccttttgatttaatttgtgtagaaatattgactaaattagtagggtatatagaattctttcttaacaatcgagcatttttaaaaggtttgagtatgaaattaacttcacgaggacgttatgctgtaactgcaattttagatattgcgttgcatggcaaagatatgcctgtgagtttggtagatatttcagatcgccaagccatttcactttcttatttagagcaactttttgcacaacttcgccgagaaggtcttgtgcatagtgtgagaggccctggcggtggctatcagttagcaaaannnnntgaggaaattaatgtgagcttgattattgccgctgtgaatgaaagtgttgatgtatctaaatgtaaaggcaatgggaattgcagtaataacagtcgttgtttaacccattcgttgtgggagcgtttagaaaatcaaatcgaacagtatttacatacgataactttagccgaattagttgaagaaaatagcgatcacgattgtgagagttctcactgccacgatcatcaccattaatcttataaaaatctcttagttaggagtaacaatgaaattaccaatttatttggattatgccgcaactacgcccgttgatgagcgtgttgcaaaaaaaatgatggaatatatgacaaaggacggcgtgtttggtaaccctgcatctcgttctcacaaatttggttgggaagcagaagaagcggttgatgtagctcgtaatcaaatcgctgatttaatcggtgcagatgctcgtgaaatcgtatttacttcaggtgcaaccgaatcagacaaccttgcaattaaaggtgcagcacacttctaccaaaccaaaggtaaacacatcatcacggttaaaactgaacataaagcggtattagatacgtgccgtcagttagagcgtgaaggttttgaagtcacttatttagagcctgaaacaacaggtttagtggatattgctaaattagaagctgcaattcgtccagacacaattttagtctccgtaatgcaggtgaacaatgagatcggcgttattcaaccaatcgaagagatcggtaaaatctgccgtgcaaaaaaaatcattttccacgtggatgcaacacaatcagtaggtaaaatccctgtggatgttcaagcattaaacgtagatttaatgtctttctcaagccataaactttacgggccaaaaggtatcggcggtttatatgtttgccgtaagcctcgtgtacgtttagaagcgatcattcacggtggtggccacgagcgtggtatgcgttcaggtacattacctgttcaccaaatcgttggtatgggggaagcatatcgtatcgcaaaagaagaaatggtaactgaaatgccacgcatcaaagcacttcgtgaccgtttatacaacggtttcaaagatatggaagaagtgtatgtgaacggtacaatggaagcaggtaaacgtgttgatagtaacctgaatatcagctttaactttgttgaaggcgagtcaatgatgatgtcattaaaagacattgcggtatcttcaggttctgcttgtacttctgcaagtttagagccatcttatgtacttcgtgcattaggcttaaacgatgaattagcacatagctcaatccgtttctcaatcggtcgttggacaacggaagaagagatcgatcacactatcgaaatcgtgaaaaaagcagtaacaaaattacgtgaactttcaccactttgggatatgttcaaagaaggtatcgacttaaactcaattgagtggtcgcatcattaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttttgcaaaggggggaataattaacacagaggaatttaaaaatggcatacagcgataaagttattgatcactatgaaaacccacgtaacgtaggttcattcgacaaaaaagcatcagatatcggtacaggtatggtgggtgcaccagcctgtggtgacgtaatgcaacttcaaattaaagtaaacgaacaaggtatcattgaagatgcacgtttcaaaacttacggttgtggttcggcgattgcatcaagttcacttattactgaatgggtaaaaggtaaatcattagatgaagctcaagcaatcaaaaacagcgacatcgcagaagagcttgaattaccaccagtaaaagtacactgctcaattcttgcagaagatgcaattaaagcagcgattgcagattacaaagagaaaaacggtaagtaatctctaacaagcggttagtttttgcaaaaaatttgcaaaatctgaccgcttgcgtttnnnnnnnnnnnnnnnnnnnnnnnnnnnnnnnnnnnnnnnnnnnnnnnnnnnnnnnnnnnnnnnnnnnnnnnnnnnnnnnnnnnnnnattcacaaggagaaaaaatgagcatcaccctaacagaaaccgcagcagatcgtgttcgtaccttccttgaaaaccgtggcaaaggcattggtttaaggttgggtgttaaaacatctggctgttcagggttagcttatgtccttgaatttgttgatgtattaaacgaagatgatcacgtttttgaacaacacggtgttaaaattattgtagatgaaaaaagccttgtttacctcagtggcacagaattagattttgtcaaagaaggattaaacgaaggatttaagtacaacaacccaaatgtgaagaatgaatgtggttgtggtgaaagttttaacgtctaagaggttctgatgtcaaatccatttacgctttttgatctgcctgtgcaattccaagtagataatgctcaactgtctgagcgttatttagccttacaaaaatcgcttcaccccgataattttgcggcaagttctgcgacagaacagcgtttagcaatgcagaaatcggcggaaattaatgatgcgttacatattctcaaagatccgattttgcgtgctgaagcgatcatcgctattcatacgggtgaacagcaagatattgagcaaaaaagtaaccgagatatggcgtttttaatgcaacaaatggaatggcgtgaaaccttagaaagcattgaaaccacaaaaaacgaagcggatctcaccgctttcgcccaagagattgaacaacagcaaaaagccattttacaacaacttgagcaagctcttaatgcacaacaatgggcggatgcactagccattaacgacaaacttcgttttattaaaaaattattggtagaaattgaacgagtagaagagaagttgtttgagttttaattatggcagattcgccataattaaaatatccgattatttgacgagtgaattaacatgtctaacttacagattccaacgagtgcgaatatattattctatacaacacctgatgaatcagtaaaagtgaatgtcttttaccaagatgagactttttggctttctcaaaaaagtatggctgagttgtttggtgttgatgttccggctatttctaaacacttagataatatctatagcacaggggaacttgttcaattttcaaccatttccaaaatggaaatagttcaacaagaaggtcatcgccaagttactcgtttgacgaatgtttataatttagatgcaattattgctgtcggatatcgtgtaaacagtcgggaagcaacacaatttcgaatttgggcaactcaagttttacgtgaatttattttaaaaggttttgtacttgatgatgagcgtttgaaacaaggtaaacagtttggtttagattattttactaatcttgttgaacgtattcgtgaaattagagcttctgagcgacgattttacgagaaaattaccgatatttatgctctagccagtgattatgataaatcttccgcccatacaaaacgctttttttccactgttcaaaatcaattacattgggcgattacaggcaaaacagctgcagagttgatttatttatacacaagccgatgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtagggacgccacgcgtggcgtccnnnnnnnnnnnnnnnnnnnnnnnnnnnnnnnnnggacgccacgcgtggcgtccctacatagaaaaataaatatgaaaaccctcgaagagctgaacgataaacaaaaatccgcttggccaattatgcaagattggttcaagcaagcgaataaccattatgaaatcctgccgagagatgtggaaaatgcaggggcagaattggtgggaatgcagttaccgacaagtacgccactgggtgcggtaatttatgaaacgggcggtattttagtcgatcacggctggttacgcattttaggttcgggtaatgagaaactgccacgcggtttgtttgagtggaattttggtaaaacctttgaacaatcgggcgaaagaccgtttcatttactgattgctgatgatgccattggtggttattttgcggtgaacggtggcggattaggcgaaaaagtcggtttagttcattatttccacccgaaaaagcagaaatgggagagtattggcttaaattattcacaatttatcggctgggcattaactgccgatattgctggtttttaccacagcctgcgtagtgaaaattggcaagctgagattgcagatttaaacggcaatcaagtgataaatttagacacaaaacaaaaacaaccgattgaacgccattatcaagcgacatttgcgcctgatgatatggggtatgcggtgaattaagtattacacttccctctttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaatgatagagagataataaaatgtcattacttcaaattgcagaaccagggcaaacggcagcgccgcaccaacatcgcttggcggtggggattgaccttgggacgacaaattctttagtagcaacggtgcgtagcggacaagctcaggtattacttgatgagaaagagcgtgcgttagtgccgtcagtagtacattatgcggctgagaataaagttgttggtgtggaagcctttgagcaagcagcagctgatccgcaacatacagtgatttctgtaaagcgtttaattggtcgttctttggcagatgttgaacagcgttatccaaatctgccttatcaatttgttgcgacggataacggcttgccgttaattcaaacgccacaaggcaataaaagcccgattgaagtgtctgccgatattttaagtcacttaaatcaatttgcagaaaaacgcttggcgggtgaattggctggcgtggtgattactgtgcctgcctattttgatgatgcacaacgtcaaagtaccaaagatgcctctcgtttggcggggcttaatgtattgcgtttattaaatgagccaactgctgcggctattgcttatggcttggatagcggtcaagaaggcgtgattgctgtatatgacttaggtggcggtacttttgatatttcgattttacgcctgagccgtggtgtatttgaagttttggcaacaggtggcgataccgctttaggtggcgatgatttcgatcatctgttagcgaattggattgcggaacaagcaggtattcagccaaatacagcaagtcagcaacgtgaactacttactcttgccactcaagtgaaaattggcttatcacaagcggacagttttactgcaaaatttgcaaattggcagggtgaaatcagccgtttgcaatttaatgagctaatccaaccgcttgtaaaacgctcgttaatgacttgtcgccgagccttgaaagatgctggggtagaagctcaagaagtgcgtgaagttgtgatggttggtggctcaacgagagtaccttttgtgcgtgaacaagtaggcgaatttttcggcaaaacgccattaacctctattgaccccgataaagtggtggcgttgggtgcagctattcaagcggatattttagtcggcaataagcctgatgcagaaatgttgttgctagatgttgtaccactttcgctagggatcgaaacgatgggcggattggtggaaaaaatcattcctcgcaataccactattcctgtggcaaaagcacaagagttcaccacatttaaagatgggcagacagcgatgacggttcacgttgtacaaggtgaacgtgagttagtcgatgattgccgttcacttggacgttttaccttgcgtggtattccaccgatggtcgctggtgcggcacacattcgcgtgacttatcaagtcgatgcggacgggttactgagtgtcaccgcaatggaaaaatcaaccaaagtgcaagcgtctatccaaattaagccgtcttacggtttaacggacgaagaagtcaccgaaatgattaaatcgtcaatgatgaatgcgaagcaagatatggaagcccgtcagctggcggaacagcgtgtggaggcagatcgtgtgattgatagcgttgtcattgcgttgcaagaagatggtgcagagctactttcggttgatgaatttaaagggattgaagcggaattacagaaattgatttacgcaaaacaaggaacagatcgccaagctatccagcaaggtattaaagatcttgatcttgccacccaagaatttgccgctagacgaatgaatttatccattcaaaaagccttagcaggtaaggcggttgatgaggtgatgggataaaatccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtccgcaaaataaataacggacacacgcagtgtgtccctacaaataaacagaagatattagaggacattatgccaaaaattgtttttcttccacacgaagaattttgcccagagggtatggttgttgaagctcaagcgggtgaaaacttattagaagttgctcacaatgcaggagttgaaattcatcacgcttgtgactgttcttgtgcttgcactacttgtcacgttgtaattcgtgaaggttttgacagcttaaatgaaacatcagatcaagaagaagatatgttagacaaagcgtggggcttagaaatcgacagccgcttgtcttgtcaatgtattgtgggtgaagaagatctcgttgttgaaattccaaaatataacttaaaccacgcaaatgaggcagcacactaatgaaatggactgatgtaagaatgatcgcagaaaatctgtatgatatgaacccagatttagatccaaccaccgtgcgttttactgatatgcacaaatggatctgcgagatggaagattttgaggatgatccagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcctcgtgactaccttgctcaacaatttcgcctttatctaatacaatcaagcgatccattgccataatggtcgataaacggtgtgcaatggcaacgacagttttcccttccattaattcggtcaaattttcttgaatagcgacttccacttcagagtctaaggcactggttgcttcatctaataataaaatcggtgcgtctttcaacatcacacgagcaatcgcaatacgttgccgttgccctccagacagtttaacccctcgctcgccaacgtgtgcatcatagcctgttctgcctttagtatcactgagaagcggaataaaatcagaggcggaggctcgctcaacctcgtcctgataaaagctcatactttgtccgagcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgccacaaaatagcttctcattcctttggtgctttcaaaaataaaaggaataacctttgctcgaggcgtattcggcatatcttctggataaggattaatgcgattttcaaaccaatcaaataatttatttaacacgggctttccttataagtatgatggggagtaaaaattgcaaggtaataaatgtagcggacacactcagtgcgtccctaccatttgaaaagaaactattgttagttccgtagcaataactatggatttagcaatttctcatctaatgctaaatctttgttacggttaataccaatcggttgttttaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacgcgcaatttcgtgtgcatcagcaagagaatgttccttatatgaaccacattgaaactcatttaactcaggaattttagtttcatcaggcactttctctaacgcatcacgcatagaggcttcccaagcttttgccacttcttcagctgaaggtgaaccaattaacgacatataaaatcccgtacggcaacccatcggggaaatatcaataatttcaacggtatcgctattgagatgatcacgcataaaaccagcaaataaatgttccatcgtatgaataccacgaggcgataaaatctcaatgtttggacggacaaaacgtaaatcaaacacagtaatcgtatcgcccttcggggttgtcattgtttttgcaacacgcaccgcaggagcgttcatacgagtgtgatccactttaaagctatctagtaaaggcataacgattctccaataaataaaattatgtggggattatagcctatttaagcctgagttttcatacaagcggtaagttattcgaaataatttgcaaatttttacttcaaacaaaccgcttgctttctagtcagttcaatcaaaattctgtataatcgctcgtctttttgtgatcttcatcacaattttggatttcgtcagatgagctttagctcatcatttttattctcggtgggcgagccccaccctacaattaagttatttcaatgcaacaattagatactcaaaaactgcgtaatatcgcaatcattgctcacgttgaccacggcaaaaccacgctggttgataaattattaaaactttcaggcacattagacacttctcgtggtgatgtagatgaacgtgtaatggactccaacgaccttgagaaagagcgtggcattaccattcttgcgaaaaataccgcaattaactggaacggctatcgtatcaatatcgtagataccccaggacacgcagacttcggtggtgaagttgagcgtgtactttcaatggtggactcggtattacttgtggtcgatgcctttgacggtccaatgccacaaacccgtttcgtaacccaaaaagcctttgctcacggtttaaaacctatcgtggttatcaataaagttgaccgcccaggtgctcgccctgactgggtggtggatcaagtattcgacttattcgtgaaccttggtgcgacagacgaacaattagatttcccaattatttatgcttctgcattaaatggtgttgcaggtttggatcacgaagatcttgcaccaaatatggatccgctctttgaagcgattgtagggcaagtttctccgccagatgttgaacttgatgcaccgttccaaatgcaaatttcacagttagattacagcaaatatctaggcgttatcggtatcggtcgtatcaaacgtggtacggttaaacctaaccaacctgtgactgtcattgatgcagaaggtaaaacccgtaatggtcgtgttggtcaagtgttaggtcacttaggcttacaacgctatgaagcaaccgaagcctatgccggcgacatcattgcgattacaggtttaggcgaattaaacatttcagataccttatgtgacatcaacaatgttgaagcacttccagctttatctgttgatgaaccgacagtgacaatgttcttctgtgtaaacacatcacccttctgcggtcaagaaggtaaattcgttacttcacgccaaattttagagcgtttgaagaaagagttagtgcataacgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgtcgcattacgcgtagaagaaactgatgactctgatgttttcagcgtatcgggtcgtggtgaattgcacttgtctgtattaatcgaaaatatgcgtcgtgaaggttatgaattagcggtatctcgtccaaaagtaattttcaaagagattgatggtcgtaaacaagagccgtttgagcaagtgaccattgatattgaagaacaacatcaaggggcggtgatggaagcgcttggtatccgtaaaggtgaagtgcgtgatatgatcccagatggtaaaggtcgtactcgtttagaatacattattccaagccgtggcttaatcggtttccgtaatgagtttatgacgatgacatcaggtacaggcttactttactcaagtttcagccactatgacgatgtaaaagcaggtgaaattggtcagcgtattaacggcgtattgatttcaaacggcacaggtaaagcccttgcttactcgctctatgcactacaagatcgtggtaaattaatgatcgatcacggtgcagaaatttatgaaggacaggtaatcggtatccatagccgttcaaatgacctaaccgtaaacccgcttgaagggaaaaaactcaccaatatgcgtgcgtcaggtaaagatgatgctttaaccttaacaacaccagttaaattcagcttggaacaagcgttagaatttattgatgatgacgagttagtggaagtaacaccaaaatcagtgcgtattcgtaaaaaattactcactgaagtagaacgtaaacgtgcaagtcgtaccacgacaagtaccagcacgaagtaatgagaagtaggggcaacaatgcccctaataatttataggagattaaaaatgtttgtagaaatttacggcagattaagttgtccttattgcgttcgagcaaaacagcttgcagaaaaaatgaaagcagaattacctgatttcgattttaaatttgtcgatatgatcgctgaaggtattgaaaaacaaaatttagaaccgcgcgtgggtaaacccgttgcgactgtgccacaaatctttttagataatgttcacgttggcggttattcggattttgctcctcttatagaagagaagtttggaattaaattataagaagattttaacttacctatttggaattcggttagttaatctgtagcattgcctataataggctcctgacatatgagagagctttttaagggattgtatacaaaaatttatataaaaattaggttaaagccttattgttataaggctttaactttctaatcaacaaaaattattcattattttagtctattaaaaatcgttatatttagatatgagatcagtttttttatgaatttagaatacttatttcatatgggaacctattatgatgaatagaattatcaatataggagctggtgtaatagacaaaatagcaattaagaaatcattataaatatttagactgtcgggagtaatatcacagggtatgagatcacgtagatcgtgttctttactctccattgctattgtgtttcagtccattaagcgcaaccagccctttatcacaactttttttctgcatgatgagatctaatttgaggatctgttgttttgatgaagagagtttgttcttcattgtctgcatttgagtatgtgtaccaggttgtttttctgcatcagcaatcagtttatcaacttcttgaaacattttttggcactgttcaggtaatatgccattggtttgaggtttggtcattaccagtgaagatgttttcaattcagtagtgaaaccacttattgcaatgaataacgcaccagttgcgataatcattgaacgtaaaatagcgtttttcatagtgttcctaatgattagtttaactgttagatgaaagttacgcatattaacatagatctcaaggtatcgtcacgtactatttaaggatctttatnnnnnntgtaaataatttgttaaactcaaaagttctattcacaaataatttacaaannnnnnnnncagataaatgagtggtattttgcctaacttgatttatatcaagttgtaacaatataaatttcatattttttaaatatttagctcaaaaatgtgatcaatgtaataattttgctattttttatttgcttatttacgagtagaatagattcttgacattattgctacttattaatctttgattggtaactgtgcaaaaacaatgttgattgggggattacttggtattcttgtaatcgaataattcagacttgtatataaagaggtttgagatgttagacgttgttgaactctcacgtttgcagtttgctttaactgctctctatcacttcttatttgtaccgcttacattaggcctttctttcgttcttgtggtgatggaaaccttatatgtaacaacaggtaaagaagtgtataaggatatgacaaagttctggggtaagttatttggtattaactttgctctaggagtaacgacagggattacaatggaattccaattcggtactaactggtcatattattctcattatgtgggtgatatttttggtgctccattagcgattgaaggcttaatggcgttcttcttagaatctacttttattggtcttttcttctttggttgggatcgtttatcaaaaggtaaacacttactaacgacttttgcggtcgcatttggttctaacttctctgctttgtggatcttagttgctaacggttggatgcaaagccctgcaggttcagaatttaactttgaaacaatgcgtatggaaatggtcagtttctctgacttagtgctaaacccagtaacacaatctaaattcttacacactgtttcagcgggctatacctgtggtgcgatcttcgtattaggtattagtgcatactatatcttaaaaggtcgtgatcttggatttgctcgtcgttcattctcagtaggtgcaagtttcggtttagtcgccatcatttctgtattaatcatgggtgatgagtcaggctatgaaatcggtaaagcacagcctgtgaaattggcggcaatggaaggtgaatttgaaactcacccagctccagctgcgtggaatgcgtttgttattcctaacaccgctgaaatgaaaaatgaannnnnnnnnnnnnnnccttatgctgcaggtattatcgcaacgcgttctttagacaaagaaattaaaggtttgaaagatcttcgtgaagagaatgtacaacgtgtacgcaatggtattgttgcttatggtttattagaaaaattacgttctggtaactatactgaagcagataaagaagcatttaaagcggttcaaaaagatcttggctttggtttacttttaaaaccatatacagataaagttattgatgcaacagaagagcaaatcttaaaagcagcagcggatactattccaaacgtaggtccaacattctggtcattccgtattatgatgattgccggtggtttaatgttattactcattatcgcagcatttgttcaaaatgtacgcggtacagtaggtactaaaccattgttattaaaagcattgttatggggtattccacttccttggattgcgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttagctgagtatggtcgtcagccttgggcagtgtacgaagtattgccaacaggggttgcgaactctgcattaacagcggcagatctttggatctcaatcggcttgctatgtggtttatataccgtattcttggtagttgaaatgtatttaatgttcaaatatggtcgtcttggcccaagtgcattaaaaacaggtcgttaccactttgaacaatctgcgaaataagtaggagtaaaatatgttagattatgaagttctacgctttatttggtggattttaattggtgtacttttaatcggctttgcgattaccgatggtttcgatatgggagtattaaccctattaccaatggtaggtaaaagcaatgttgaacgccgtgtaatgattaactcaatcgctccgcactgggacggtaaccaagtttggttattaactgcaggtggtgcgatctttgcagcctggccaacggtttatgcagcatcattctcaggtttctatttggcgatgatcttagttctagcggcattattcttccgtccagtgggctttgaataccgtgcgaaaattgatgatcaaaaatggcgtaatacttgggactggggattatttgtgggaggtttcgttccatcattaatctttggtgttgcattcggtaacttattacaaggcgtaccattccactttaacgagttaaaccaagtaacttacgaaggttcaaccctttggaaattattaggcttattaaatccatttgcattactttgcggtgtggtaagtttaatgatgcttaccactcaaggtgcaacttggttacaaatgaaaacaacgggcgaattgcgtaaccgtgtaagaaatgttgctcaagtgaccgctttagtagcgttaggtgcattcttacttgcaggtgtttgggtttacttcaaagatggctttgtgattaccagtgctttggatcacaatggtcaatctagtttagtgaacaaaacagtcgtattagaaagcggtgcttggttcaaaaactactttgaaatgcctgtattattcatcattcctggtttagcggtgattggtgcattaggtactgtggttagctctaaagcaaataatggtggacttgcattcttatgttcatcaattatgcaagcgggcgtgatcttaacggcaggtgttgcaatgttcccattcgtaatgccgtcaattactcacccagaaatgagtttaacaatgtgggatgcaactgcaagccataacacattaacagtaatgtttattgtggcgtgtatcttcgttccaatcgtattagcttatactgtgtggacttacttcaaaatgtttggtcgtcttgacgctaaatatattgaagagaaaagtgcaagtttatactaaggagaaccaatatgttttatgtaacttgggtactaggtgtgttacttgctattctgtttgcaacagtaatcactgtaagtattgaaaaaacaggtaagtttgacgagtaagatggttaattcactctatcaactcacaagaaagggctggctacaagccctttcttttatcctttctattgcaatgtttgcaatgatattgctctattccaacacctttgctctctactttggtggaaaaattccttatttagtagcaggcgttttctatggtatgttgattttatttgttcacggttttggctttgagattaaatcaacacgatggcaaatggtttttatgccgttgttgggatatgccattatcttaccttcattaattgcattagtcgtgctgcattagcctttaaattaagaacccaaagcaatgggttcttatcatattgcttgttttatatttaatttatttctaaaaatacttgcacaacgatttttctctctctaaaatggcgagtaatttacgcctgatttttgggcgtttttcgttttggaaagatagatagggcattgcaatggattttcctattcgtgtgtattatgaagatactgatgcaggtggtgtggtttatcacgcgcgttatttacatttttttgagcgtgcaagaacagaatttttacgtcaattaggcttttctcaacagctattattaagtcaatcaatggcttttgttgtgaaaaaaatggatattgactataaaaaacctgcttatttagatgattttctcacagttaaaagcattatttctgaactaaagggtgcaaaaatagtctttaaacagacattatggcgagatgaggagtgcttgtgtgaagtgagtgtggttgtcgtgagtgttgatctagcaaaaatgaaagcaatcgccatacctgaagatattaagcaggcttttaacgctataatctcaatgtaattgttttatttggagtttttatcaatggcaactgaatttaatttagtttcattatttatggaagcgagtattgttgttaagttagttatcttaatactgatctctttttccgtgttatcttgggcagtgattattcaacgtagccgcgtattaacaagagctaaaaaagattctttaaactttgaagatcgtttttggtctggcgaagatttacatcgtttacacgaagggttagaacatcgtcgagatggtttaactggagctgaacaaattttctacgttggttttaaagaatttaaccgcttacagcaagcaaacccagattcgtcagagtcaattattcaaggttctagccgtgcaatgaatcttgcattaaaccgtgaattagaagaacttgaaaattacattccgttcttaggtactgttggttcgatcagcccatatattggtttatttggaacagtttgggggattatgcactcatttatgggactaagtgcggtaaaacaagcaaccttacaatctgttgcaccaggtattgccgaagcattaattgccacagcgattggtttatttgcagcaattcctgcagtaatggcatataaccgtttgaacttgcgtgtaggcaaattagagcagaattatgtgaactttattgatgagttcaccacaattctacatcgcaaagcgtttgcgaaaaaataagtaaaaattaagtgaaatgctaccgcttgttgtggtagtttgaatggatagataaagaggaaactatgtcttaccgtcgtcgtaaacgtaatgacattaaatctgaaattaacatcgtgccatttttggacgtgttactggtgttattgctgatttttatggcaacagcaccgattattagtcaaagtgtggaagtggaattgcctgaagatcgccatagtcaatccgtttcaaatgaagataaaacccctgttattttagagatcgctggggtcgctttgtacaaattgaaaattgacggaaactacattcaagttaatgaacaagagaacttagcggagcaagaagtcattgcttatgctggtgaggctttccaaaaagacaataataccttattccttgtggcaggtaaagacgtaccttacgaagaggtaatgaaagggatctcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaggcttattaatactgggttcttttttcactaatactcacttagcttctgctggcggaagtggcggtgatagtgaatctcttgaagctgtgatggttgatactggacaggtagccgctgaatatgggcgattaaaagctgaaaagcaagggcaagcgaaggttgaacctaaagaagagcctaaagaggaagttaaggaagaggttgaagataaacctaccccagaagaaattgctgaacaacaagaacgtgagaaggcaattcagttagctcagcagaagcaacaagaagaaaaacgtcagcaagaattggctcgtcaagaagcattgaaacaagagcaaattaaacaagaacagttgaaaaaacagcaggaagaagcaacacaacgtaaacttgcagaagcagcccgtttgaaagctgaagctgaagcaaaacgtttagaagcccttgcaaagcaagcggaagaagaacggaaaataaaagaagcagagcaacaaaaacgacttgaagagcagaaaaagctaaaagcagagcagcaagctaaagcacaagcagaaaaagaagcaaaagagaaagcagaacaagaagcgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcagaacaagaagcgaagctcaaagcagaaaaagaggcgaaagaaaaagccgagaaagaagctaaggcaaaagcggaaaaagaagcgaaagccaaagtcgctgcagaggcaaaagcgaaagcagaagcggctgcaaaagctgaaaaagcgaaaaataataaagtacttgatgattttttaagtggtggcgaagttggcggaggcacgagcaacggcggtaataaaaatagtgccggctcacaaggctctggcggtactaaaggcttaggtcaaggtgctaacgttgatggtaatgcctatgggcaacgaattaagaaacttattcagtcaaaataccgtgttgatccgagttttgcaggtaaacaatgtgatgtgaagattttcctagagcgagatggtactattaccaactatcaagtcgtttcaggggataaagcagtgtgtgatgcagctgtaagtgcgattgtggcaacccgtaaagtgccgcctgcaccgtcagatgcagtttatcagcaatatagatcaccaacattagattttagtttaaaagttcaatagttcaacctagagggttaagatgaaattagtatctcgtttaacgagtattcttggtgttatcggattatttttttctgttagtgtaaaagctgagtcagatgttagaatttcgattgaccaaggtgtgagtatggctcaaccgatagcggttatcccatttaaagcaatggggggcgtacctgatgatgtcgctcaaattatcgctgatgatttgagaaatagtggcaagtttacaccgcttgatcgtgcgagtttacctgcacaaccaagttcagcggtagaagttaatcctgaacagtggacgaatatcggcattgataatgtggttgttgggcaagtatctgtggtaggtggtggctataacatcgcttatcaattagtggataccctaggaaagtcaggggcagcaggcaatgtgattgtacaaggttcatttaatgttccagcagctcaaatgcgtttaggggctcatacggtaagcgatcaagtatttgaaaaattaacacagatccgtggtgcatttagaactaaaatcgcttatgtggtacaacgtggagtgtcctcttacgagttgcgtgtatcagattatgatggttttaacgcctttaccatcgtaaaaagtaaagagcctttaatgtcaccagaatggtcaccagatggttcaaaattagcttatgtgacttttgaaaacaaaaaatcacaggttgttgttcacgatattcgttcgggagcaagaaaagtggtcggatctcttagagggcataatggcgcgccctcattctcaccagacggttcaagagtggcgtttgcttctaaccaagatggtgtattaaatatttatgtaacaggggtgggcggtggttcaccaagacaattaaccagtaacgcaggaaataacaccgaaccaagctggtcaccagatggtggttatatcttgtttacatcagaccgtggtggcttaccacaggtttatcaaatgagttcatctggtggcggtgctagcttaattggtggcagcggcagtggtaaaatttcggcagatggcaagaatttaatcatggtttcaggtgatagaattgtaagacgagatcttgtttcaggtagcacagaagcaatcagttctacgtttttagacgaaagtccaagtatttcaccaaatggaacaatggttatttatagctctaccaaaggtgtgagtaaagtgctacaattggtgtccgcagatgggcgtttcaaagctaatttgccgggagcaggtggacaatataaattccctgcttggtcaccttatctgactaaacaataattcttttttggagaaaaaaatgaaaaaactagctaaagttttaatgattgcggcaccagctttcgttttagcagcatgtagcagctcaaacgacaatgcaagtgctaatgcaggtcaaacattcggtggtatgtctgttcaagatttacaaacccgttacaacactgtatattttgatttcgacagctacacactaaaagctgaagatcaacaacttttagatgcacacgcacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttagttgcatctaaaggcaaagtaactgttgcaggtcacgctgatgaacgtggtactccagagtacaacatcgctttaggtcaacgtcgtgctgacgcagttaaagatgttttagcaactaaaggtgctagcaacgtagcaacagtttcttacggtgaagaaaaaccagcagtattaggtcactcagaagctgattactctaaaaaccgtcgtgcagtgttagagtactaatttttagttttctaaaatgccaaacagtaaagctccgaaaattcggggctttatttttatgtgtaaattctatattacttaattattttttaaggattttccgttaaaatgctcacaattttgaataagtaagtaagggcagtcgatgcaatttattgggaaaattctcggtttcattttaggttataagttttttggcggattttttggcggtttgctagggctattaattgggcattggggcgataaaaaactgtatgagctaggtagcgtatcttcaactatgtttggcaaagcactaactcgtcagtcactctttatgcagacaacttttgcggtattaggacatatttccaaagcaaaaggacgagtaacggaaaatgatatccagcttgcccgtcagttaatggcgaatatgaaactcgatgcaaataatcaacaacttgctcaaaaagcctttactttaggaaaagaggctaatttcccgttacgccaagttatgcaagagttccgtgaagcctgtggacaacgccgtgatttattgcgtttcttcgtggaagttcaaatgcaagctgcattacaagatggcaatttagatggcaatgaacaacaaattttattcactatcgccgaaacgttaggaatgtctcgtttacagtttgagcagatgatagcaatggtggcagcagctcaacgtttccgctcaggctattatcaatatgaacagcaaggctcaaaccaacaaggacaatatcaaggaaattatggtggttatcagcgttcaagtgaaccaagtttaaaagatgcttatagcgtattaggggtgtcagaaagtgacgatcaaacgacggttaaacgtgcctatcgcaaattaatgaatgaacatcacccagataagttagtcgccaaaggtttaccgcctgaaatgatggaagtggcaaaagaaaaagcacagcaaattcaagctgcctatgatcttatttgtaaatcaaaaggttggaaataatgcaaaaaagttctcatatcgttccgcttttcttagcgattgtgattacggttgtttccgtatggtctggttttaacccgacagacagagccgtctggtatgcagaagtaatgccgatttttgtggtatttgctctacttctactcacttatccacgttttcaatttagtgggcttgcctatgtgctgatgtcactgtggatgattatgcacctcatcggtgcaaaatatacctttgcgaatgtgccgtttgattgggcaaatcagtatttgaccttcttaggcgaagatcgtaaccactttgatcgtgtagatcactacattatcggcttttatagtttcccaatggcagaatggttattgcgtaaacgtaaatgcggcttgggcgtggcattcttcttctcgctcttttttattatgtcagttgccgcaacttacgaaatcatcgaatggcaatatgcagtgattgaagggggtaatgcgggcattgaatttttaggttcgcaaggcgatatttgggacgcacaaaaagatatgctcgccgatacgctaggggcaattactgcattaatcatctacttaattgctcgccctgatctacgtttacgccattcttcttactaacaagcggtcggattttgtggaaaatttaccaaaagttatccttgcacctatgcaaggggtgttagatccttttgtgcgtcaattattaacgacagtcaatgattatgatctgtgcatttcagaatttgtgagagtggtcgatcaaaaactgccgaagaaaacgttttatcgcctttgccctgaattacataataacggttttacctcatcgggtacgcctgtgcgtgtacaacttttaggacaacacccacaatggttagcagaaaacgcagcacttgccgttgaactaggctcgtacggggttgatctcaactgcggttgtccgtctaaaacggtgaatggcagcaatggcggtgtgtccttgttgaaacaacctgagttgatttaccgagcaacaaaagcaatgcgagaagcggtgcctagccatcttcccgtgtcggtcaaagtgagactgggctgggatagtagcgaacaagcctttgagatcgccgatgcggtggtgcaaggaggtgcaacggaaattaccgtacacggcagaaccaaaatggacggctatcgagcagaacgcattaattggcaagccatcggcgagataaaaaaacgactgcctatccctgtaattgcaaatggcgaaatttgggattatctctctgcaaaaaaatgtcgtgaagtgaccgcttgcgatgcgttaatgattgggcgtggggcgttaaatgtgccaaatttaagcaaagttgtgaaatataatcagcctaaaatggcgtggaacgaggtattacagctcttatttcaatatgtacatatggaaaacgaactggataccggcttttatcacgtcgcacgcattaaacagtggctacgttatctcgataaagagtatcccgaagcggtgcaactgtttgatattctcaaaacagaacacggctacgaagggttaaagcaacacattatacaagcggtgagatcttaatggaaaaacgcatttttaccgaagaaatggttgaaacagaagtaaaacatcaaccaaaacaagagtttagcgacgcagacattcagcttgacgaagatccaaaagcagttgaagcagaactgattattgaagaaagtttaaaaccctcttgcttctggctaaggttatttctagctgcgttggctctgtttggcgttgcgaccattgctcaatcagtgcaatggttaattgatacttggcaagcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtggatctactttgcctttgccgttgccttttttggcatcagtttggctggtgtaggggctattatcaacgaatggagaaagttacgttggttgcgtaaacatcattatcatcagcaagtgagccaacaattactactggaaacagcggatacaagcggtgaaaaagcacgagaattttgcaaattggtggttaaaaatttggctcaaacgccgatggttcaacaggcggaacagcgttggcaatctcagcttgacgaagcctataacagccaagaagtgctgtatcttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatgcaattatcgttgccgtaagccctttagcgttggtggatattttaatggtggcgtggcgaaacattgctttagtcaataaaatcaccaaagcctacggtatggaattgggctatatcagccgtttaaaactgttccgaatggtgatgaccaatatggtctttgcaggggcaacggaaattgccagcgatgtcgggttagattttttctcacaaaatctcaccgctcgtttatcggttcgagcggcacaagggattggtatgggactgctcaccgctcgcttaggtattaaggcaatggaattttgtcgtccagtggtgttccaacaaaatgaacgaccaaaactttctgttgtcagacaagagctgatcggcgttctaaaagaacaaatgttcagtaaaagtagggaagaatttgagtttttccacaataattaattttacaatatctgcatgagtttactgatgctgtattctcttcgggggcaaaattgtgtagttgttttaaattaaatactaatctggcataatgcccgaagagcgaattaatctctgaataaaatgatttactggctgtttttgtttggatgtcaatcattaaatgatacgggcagcggtataaataatacgatttagctatagtaacttatcaagttactttcttatgaaaaaaaagagttaatcagattaattaaatgttttaggttgtctaatgaaaattgcccttggaattgagtacgatggttgccgttattgtgggtggcagcgccaacaatatgttgattcagtacagcaaagattggaagaagccttatcagtcattgcaaattcatcttgtgaagtgttttgtgcagggcgaactgatgcgggagtacatgctactgggcaggttgtacactttgatacggatgtaaatcgacctatgcagagttggtgtttagggaccaatgctcatttaccagaagatattgtggtgaaatgggctattggagtaagtgacgattttcatgctcgttttagtgctcttgctcgtcgctatcgttatgttatttataataataaattacgttcagccatattaccgaaagggatttctcattatcactattctctggatcatgaaaaaatgcatgaagcagggcagtttttattgggagagaatgatttcagttcatttcgagctgcgaagtgtcaatcacatacgccatggagaaatgttcatcatctcattgtgagtcgccatcaagactatattatattggatattcaagcgaatgccttcgttcaccacatggtaagaaatatagttggtagtttgattgaggttggaagaggcgataaacctgttgaatggattaaatggctattagaaaaacgagataggacgttggctgcaccaacagcgaaagctgagggactatacttggttgaagttatttatcctgagaaatttagtattcctcagatgccattaggacctttattctattatggtaaataactatttatgtatattttaagaaaatcagtactagtatctttgtaaatgattctagggataaatttaagatgaattgtgcagaattattagtcaatgtaaccccaagtgaaacgagggtagcattggttgaaaatggtgtgttaaaagaagtccatattgagcgtgaggcaaagcgaggtgttgtcggtaatatctataagggacgagtgacacgggttttgcctggtatgcagtcggcatttgttgatattggcttagaaaaagcggcatttttacacgcatcagatattgtttctcacactgaatgtgttgatgaaagcgagaaaaagcaatttgttgtcaaaaatatcagcgagttagtgcgagaagggcaggatattgtggtgcaagtggtcaaagatcctttaggtactaaaggggcaagattgacaacagacattacattgccctctcgttatttggtttttatgccagaaaatagccatgttggtgtgtcgcaacgcattgaaagtgaagaagaacgtaatcgcttaaaatcgttagttgagccgtattgtgatgagctaggcggttttattgtaagaacggctgctgacagtgtgagcgaagagagccttgaacaagatgcggctttcttaaagcggttatggcgaaaagtactagagcgaaaaggaaaatatcctgcgagatctttactttatggggaattagctttggcacaacgagtgttgcgtgatttcgttggaacgcatattcattcaattcaaattgactcaaaaatgacctatgagcaggtaaaagagttcttagctgagtttatgccagagttagccaagaatgtgagtttatatagtgggactttacccctctttgatgtttatcgcattgaagatggtattcaaaaagccttggataaacgtgttgatctaaaatcaggtgggtatttaattattgaacagacagaagcaatgaccaccatagatattaacactggggcttttgtcggacaccgaaatcttgcccatacgatttttaatactaacattgaagcaacacaggcaatcgcacatcaattacaactgcgaaatttgggtggtattatcattattgattttattgatatgcaggaagaagaacatcgccagcgtgtgctagagtccttagaacttgctttaaaaggtgatcgagtcaaaacaaatgtcaatggttttacccaacttgggttggttgaaatgacgcgtaagcgtaccagagaaagccttgaacgagtgttatgttgcgattgttcttcttgtaaagggcgaggtacgataaaaaccgttgaaacagtctgttatgagattgttcgagaggtcgttcgagttcatcatttatacaagtcggaacgttatgtagtatatgcttctcgtagcgtggcggaatacttgattaatgaagaatctcacgcattgcttgcggaattagaagtctttatcggtaaaaaagtcgaaattaaaattgagccgtattatcaccaagatcaatttgacgtagtagtaatgtaatattaggcttgatagcttaaaaaataagctattttgaaataaagttgttgcaaaatacaggggggggcttagaatgcccccgtcttttatttgaaagacttggtttttttggagtaatccaacctcttctttattttactcttttaggagaatacattgatgaaaaaatgggctgttgcattcacttcgggtatggtgatgttaggggcaaatagtgcattagcaaatgacactgtacatctttatacttggacagaatatgtgccagaaggtttgttagaagaatttactaaacagacaggtattaaggttgtggtttcaagtcttgaatcaaatgagacaatgtatgcgaaactaaaaattcagggtaaagatggtggttatgatgtaatcgcaccaagtaactacttcgtgtcaaaaatgggacgtgaaggtatgttaatggagcttgatcatagcaaattacctgtgatcaaagatcttaacccagactggttaaataaaccttacgataaaggcaataaatactctttaccacaattattaggtgcaccaggtattgcatttaatactaattcatacaaaggtgataatttcactgcttggggcgatttatggaaacctgagtttaaaggtaaggttcaattacttgatgatgctcgtgaagtattcaacattgctttattaaaattaggtcaagatccaaatactaaagatccagcagtgattaaagcggcttatgaagagttattaaaattacgtccaaacgtattagcatttagctctgataaccctgctaactcatttatttctggtgaagtagaagtgggtcaattatggaacggttctgtacgtattgcgaaaaaagagcaagctcctgtaaatatggtgttcccgaaagaaggtccagtattatgggtggatacgcttgcaattccatctaatgcgaaaaacccagatgcagctcacaagttaattaactacttattgagtgcacctgtggctgagaaattgacattagaaatcggttatccaacttcaaacgtaaaagcgttagaaaaattaccaaaagagattaccgaagatccagcaatttatccaacctctgaagtgttacaaaaaagccagtggcaagatgatgtgggtgatgcgattgagctctatgaaaaatattatcaagagttaaaagctgcgaagtaattccatagacatcgcttaaaaacctcaaggcttaccttgaggttttttgtatgaacttttcttgcaattttcgttctatattgccgtaggaatttatgttaaaattctcagctgtatctaaacgaagaagagattgtatgaatatccgtttaaatattattctagccacattagcagcagtacttgctggttggtattatagtcaacaaagcaatggtactggattgtctcagctaataaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaaggaagtgcagagtatatagggcaaaagatttctgcaagtgcttatgatttaaatggaaagccgcaatattttgctcaagcagaagaggttaaacgttacgaaaatacgcaacgaacagaatttctaaagccattacttaatttatttgatgcagaaagtgcattaaaacagtggcaagtcgaagccgattatgcagatgttaccaaagataaaatattgaatttgcgtggaaatgttaaaattaatagcttagatccgacttctcggttacagaaaatcgaagcagaagtgttaagcatagatttaaatactcaagatattttttcagacagtacggtgaaatcaacaggtattggatttacaagtactggaattggcttaaaaggcaatttgaaaaaacaaacggcaaccttaaccaaagatgtgaaaacttatattgaaccaaaatttattaatgttgataaataattagagttttacatagggatatagaatgaattttagaactaaacttgtattaataattgcattgtgtcttgtaaatctatcggttaaggctttggaaacagatagaaatatgcccatcaaaattgattcaggtagccagtcattggatatggaaagaaatattgtgacatttagcgacaatgttgttgttactcaagggtcaattaagcttaatgcagaaaaagttacaatcattagaagggatactcaaaaggaacttattgaggcttttggcacaccggttgtttttcagcagacccttgataatggtaagactgttaatggtacggctaattctgtacattatgatttagattctgaatttttgatattaagaggcaatgccgaattaaagcagctagatagtgccattaaagcagaaaaaattacttatgatgtcaaaaaacagaaccttaaagcgacgagtaatgaccgacaaagagtaaaaactgtattaattccaaaccaattgcaaagtgataagaaataggaattctgtatgccaacattatatgctgaatatttggctaaaagttataaaagtcgccaagttgttaaagatgtaagtttaaatattaaatcaggcgaaatagttggactattaggtcctaatggtgcaggaaaaacgactactttttatatggtagtgggccttgtgcgtcacgatcatggtaaaatccgtattgatgatcaagatatcagtgttttacctatgcatgatagagcaaaacaaggtattggttacttgcctcaagaagcctctatttttcgtcgcttaagtgtttatgataacttgatggcggtgttacaaattaggaaagatctaaccgatgcagagcgtcaagcaagagcagatgaattaatcgcagaatttcatattgagcatattcgtcacagcttagggcaatctttatctggcggtgaacgccgtcgagtagaaattgcacgtgcgttggcagctaatcctaagtttattttgttggatgaaccttttgctggggttgatcctatttcagtgatcgatattaagaagattattgtgaatttaaaggaacgaggattaggtgttttaatcacagatcataatgtaagagaaaccttagatgtttgtgagcgtgcttatattgtgagtaatggtcagatgatagctagtgggattcctcaagaaattttacataatgaggatgtgaaaaaagtttatttaggtgagcaatttaggctgtaatataaaattcttaagatatttttttgtcgtttgattttttatgatgcaattaaccacatttttagacattaataatatttattacaatgttcccatttctaataaaaaacaggctttagagtttctggggaaggcgatggcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcacctacagataaactatgtattcatccagcagaatgttttagctatttctttaaacgtgaaaaattaggttctaccggaattaataatggagtggctttacctcacgcaaaattgttgatgagtcaagaatttcagctagagaaaccaattgctattttcctgaaactagaggcaggaataaattttgaatcaatagatcataaggatgtggatattatttatgccatattcttttcagaaaaaatttgtgtagaatataaggattctttgagagaaatagcacagcaattaagtgataagaatttgttaaagcatctaagagctgcattatccagagaagaaatttggcaagtattgagttattatgattattcggtaaacaaaaatttagaatcgaggaatgtaatgtggaattgattattatgagcgggcgatctggttcaggaaagtctgttgcgttaagagcgttggaagatttagggtattattgtgtggataatattcctcttgctttaattccccagttaacagattatttagaaaaattgaagagatctgttgttgttagccttgatgtgagaaatttaccagaagatccagatgtgcttgagcaagtattacatgcgtttccctctcacatttcaaaaactttaatctttcttgattgtcagcgtaaggctttagtccgtcggtatagtgactctcgtcgtttacatccattatctacccatgatttatctttagaaaatgtgattgatttagaaaatcatcttcttgaaccattatttcagcatgcggattatattattgatacaacgtacttttcttcacatgagttagcagagaaattaagagaattattaaatggatcatcggagaaagaattgaatattattgttgaatcttttggttttaagtatggcattcctgccgatgcagattatgttttcgatgtccgttttttacctaatccccattggaatcttgagcttcgccctatgacaggattagaaaaacctgttatagattttctagaaaatcagccagaagttcatcaatttatttctcatacttgtaattatttagaagtgtggttgcctttattggagcaaaataataggagttatttaacgattgccataggctgtacaggcggaaagcaccgttctgtatttgttgcagagaaattagccaggtatattgaaagtaaaggcaaaaaagtaagagttcgtcactgtagtttagaaaaacattataagacatcgtagaatgaaaacagcagatattaccatcattggtggaggaatggttggcttagctttagcaggattacttgcaaatagtaattgtcaaatcaagattattgataaaacagttccctatttaagtaagtcaatcagtaatagagtaagtgcaattaattttactagccaaagaatgcttgaggaaataggtgcttggtatcatatttctgaaagtgatttatctccttatgaccaaatgtatgtctgggaaaaggatagtttttcaagtctctgttttgacaataaagatcccgtaatcaaagaacttggactagagcagctaggatttattattgataatcagcagattcgttatgctctatggaagcaagtcattcatcagcataatgtagaagtgatattggatgctcctaaatttttaggcattaatgataactgcgcttttttaactctagaaaacggagagatgattacaagtaagttagttataggtgcagatggagctcattcttgggttcgtcaacaagctaaaattccattgattagtagagattatcaacacactgcattagtatgtaatgtgagaacaacagaaatgcatcaacaagtggctcgtcaagttttttcgcctgatagtattttagctttcttgcctttaaaagatgaacatctttgttctattgtttggtctttgcctacacttgaggctagtagactagttaatagtgatgaaaaatcttttctcaaacaattgaatattgcttttgataatcaattaggaatatgtgagttacaaagtgaaagggatgtttatcctttgaccgcacgttatgctcgcgattttgcccagcaaaggattgctttgattggtgatgcagctcatacgatccatcctctagcgggtttaggtgttaatttaggttttgcagatgctattctattggcaaaagagctacagaaattactctcctttggaaaagatataggagagtaccgcaatttacgtcaatttgaacgagttagaaagttagaagctataaaggttttagttgcaatggagggcttaaagcaccttttctctggcaataatccatttaaaaaattagttagaggtgttggattatctgcaactaatcaaaatagttttgtaaaaaagctacttattcagcaggcaataagtgtgtaataactggataagaatgatttatatgaatatatttaataaagatttttttagtattatttggatattttgaaataaataagtttattaaaattattaccttagtattatgtatgatgtttttatcttcttgtgataatgtcggaaagcatgagagtaacaatagtacttctttagaaaaaaaacatcaaaagaagatgtgcatacagtggagagttcggcttctattgaagctgtggaagactttaataagttggtattatggaatattaagcaagaacaggtattagcagaattgcaacaaaagctgagcagtcaagataaatctgaaattgaagagggattgaatatctttaaaactagaatatcttctattatacaaaatctagagatgatagaggttaaaaatacggatattcagttattgaaattaaggattaaagaaaatctgattttattaaatgattttattattgaatcagtagaaactatgcaaaacccgactttagaaggacaggaaaaaattaaagaaaagtcggatagattattgttactgaataaagaactacagaaatttgaaagcgatttaaaagagaaatttggtattaaatgaagaatataaatataattttttataatatttcctcttattttcttagatggattgacaattttttattaaataatagaggaaataatgctcaaaatttataacaccttaaaacgtgaaaaagaagaatttaaacctatctaccctgatcacgttggaatgtatgtctgtggtgtcacggtttacgatctctgtcactttgggcacggacggacttttgtttcttttgacgtgatcgcacgttaccttcgctatctcggctataacttacgctatgtgcgtaacattacagatgtggacgacaaaatcatcaaacgttcgttagaaaataatgaaacttgcgatcagcttgttgatcgtatgatcatcgaaatgcacaaagattttgatgcgttaaatatccttcgccctgatgttgaacctcgtgcaacgcaacatatccctgaaattattgcgattgtcgaaaaactcttagcgaaaggtcacgcttatgtagcggaagatggtgacgtgatgttcaatgtcgaatctttccaaaaatacggtgccttatctcgccaaaatcttgaacagcttcaagcaggggcaagggttgaaattaaatcggtcaaacgcaacccgatggatttcgtattatggaaaatgtcgaaagagaatgaaccaagctgggattccccttggggcaaaggtcgtccaggctggcatatcgaatgttcagcaatgaacagcaaagagctaggcaaccattttgatattcacggcggtggttcggatttaatgttccctcaccacgaaaatgagatcgcacaatcttgctgcgctcacggtgacgattatgtgaattattggctacacactggaatgcttacgatcaacgaagagaagatgtcaaaatcgctcaataacttcttcaccattcgtgatattttaaacaaatatgattgtgaaagtgttcgttacttcttcttaaccgcacaataccgtagcttgttggattacagcgaagaaaatatcggcttggctcgcaaagcgttagaacgtttatatacggcactgcgtggctgtgactggaatgttgaacttgcagaaaacgatcagtatgtgaccgctttcaaagagtctatggacgatgattttaatacccctggagcactcgcggtgttatttgaattagctcgtgaagtcaataaactcaaagcagaaaatcaggcggaagcgaacaaacttgcagctcgtctgaaacaacttgcaggcgtgctaggtttgttagagcaagatccagaaaccttcttacaaggcgatgccaataatgatgaagtggcagaaatcgaagccttaattaaacaacgtaacgaagcgagagccagcaaaaactgggcggtagccgatgaggcacgcaataagctcaccgcaatgggcattgtgcttgaagatggtgcaaatggtacaacgtggcgtagggcttaattgattaacaagcggtgggatttgacgaaaattttgcaaatccgaccgctttataaattaaatgtattatttaccccatacctcttcagcgatgtctcggataaattttaatttattccactgttgctcttctgttagaatgttaccttcttcagttggtgcaaagccacattgtggactaagacagagttggttaatgtctatgtattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcgcgattgactaaataaacatagtcttttgcgagttgttctaaatcgaaccctcgagcttgataagcagctcgcttctcttctgaacaaagctctccccaacttgtatcatctaattgtaaattacggcaacctaatgcatagaatttttctattgccgatttataagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagcaatatcatctaatagctggctattattatttttgttgctcaactaattttgtaatttcagcatcttcaatttgagtcagttcactacaaggtaaattgccacattggcattgttggcgagcatgttttaagctttcaggacgtagaaaacttcccacaatatcaaaacgataaggggcttgggtacgaggttgtgcattgggaaagagtttagacataatatttccttatttttagtgtagatatgaaaggattctatcaactgtggatcaaaatagtaagtaaatgatgtaaacgatttatttttagaaagacttatataagggagcttaatattttaagctccctaatagattaaggcttcagacttacgccataaaatgcggtatagccaaacggattttgaacaaagccttgtacccgtttatttaacggtacgtagttaatggagtgggcaaacggaatgatcgggctgttttgttggaaaatttcgactgcctgttgatatagttttgcacgtgtttgtgtgtcttgaatttgtaccgctgaggcgagtagcgcctcaaatttttcatctgtccagcgagagtaattggtgccggggatatttgcttggctaaataaagggaatagaaaattatcaggatcaccgttacgacttgtccaaccataagtacctgcggcaaattcgccttcacgggtgcgtttattaaaatccgcccattcatgtgtgactagttttgctttcacgccaattttagcccagtctgcttgaataatttcagccgtgcggcgagggttcggattggatggacgaaccacaggttgcacccaaatttccgtttcaaaaccgtttggatagccggcttctgccaataatgcttttgctttttccaagttaaattcatattgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaatgtccgagatattcggaaaatcaatcacatcacactcgccagcttttaacttggcataacgtgttccagcatcaggggtaatgctaaaaattaaacgttcaatgtctgctttgcctttccaataatctacgttagcagtgtaacgtaccgcgtggtcggtctgataagtttggaaaataaaaggccccgttccaatcggttgttgatcaagagtttcgggcttaccctgggcaagaagctgatcggcatattcttttgaataaatagataaaaagtccatggcaaccgtggtaataaacggcgtattcggtttattcagcgtaattttaacggtgtagtcatccactttttcaacggattttaagatactcggtaagttcatccagttaaagtagaagtaggttcctgccgaaacattatgataaggatgatttttgtccgcttggcgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggaatgagaacaccacatcatcggcatttaacgggcgggttgggctaaaggttttgttgctgtggaatttcacattttggcgtagataaaatgtatagaccaaaccgtcttcactgatttcccaacgttcggctagacccggctctacttcaattttaccggctttgaattcgactaagcggttatagacttgttgtgagctggcattgaagtcattagcatcatttgtaattgccggactaagtttcatcggtgctgtcgcaatacagttgaccaatgtatttgtcggtgccgaaatcgcggcacatgaagcagaaagaaaacccaagccgagaaagagttttgaatattgcataataagttccctaagttgaaaattccagctcaatctaccgtttttagtgaaaaaattaaaataactgaaggctctaacttataaccaaaatgatatacatacatcggtaacattcctcttatagataacttacgctaaaatatgtcttgagtggcttatgtttgagtgtgtttatgattagtgtctttgatatgtttaaagtgggaattgggccttcaagttcccacatcgttggtccgatgaaagcgggtaaagaatttattgatcatttaattgattgcaaaaaattggcagaaactgaccgcttgcaagtcgatgtttattgtattgaacgcaatgcgattgcttcggtaaaagcaatcaatgcaagccgaatggcattacgccgaacgacacaaccacgcgtaaccctagataaagtgatcgaaacgatgtatgaaacagggaaagatatgaatgcgaaataccgcgaaacttcaacaggtggattagcaattaagatcttgccttgtgaatgatagatagtatctagtgaatgtgtaaacactaaaggtaaaagttgaattaagtaatttgattttgaagattagcagagcttactcacccattctttcaactcatctttcggcagttttttcaatttcgggcaattgccacagtaatcatttttgctatccaagtgggcgtggcaacagacttttcgtaagcggacgggctgtggaaaaggcaattcggggaaggaaatatattcaacggcgttataaaaaggcgaccattcatattctgtccatttcttttcaagcagaatttgacggtaggtttcactcacatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggcttttccacaaaagtaagcaaattacggcaatgttttaagcgttctgaaaataagttttgacgaagtgnnnnnnnnnnnnnncaattaaaaagtaaattcataaatagataaagaagtaaatctattttagaactttacacttcactcggatttttatgtttgtggttaaacaggcaagttttgccattccaaatcgtacgttgttacagccgatttcggtgcaatttgaacaaggaaaagtgtatggattgatcgggcataacggttcaggtaaatccacgttaatcaaattacttgccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaatatgtaagtaataaacaatatgctattggatatgaatttactcataaatttaccgatgacttaactttctcacaaaactaccgctttgccaaaacagataaagagcaatttgtaacctattactacggcatggaatgggatcctacaacaggtggcgcaagtaatactatggctaaaaaaaggcttcctatttgctgatggtaaaacatattcccatactattgacacccgtttaagcaaagaatggaaatcagataatatttcaaataccctaactggtggttttgattatcaacacagcaaggttgatggggtatatgatttcccttggcctgctacaagctatcatattactcaacttgttaccgctccagttaccttgactgatgttccagtttataaagataaacaacgccagctaggcttgtacttgcaaaatcaattacgtttaaacgaaaaattaactgtaactggtggcgtaagacgtgattttgttaaaggtcacagcgatattcgaggaacaaaatcagaaaataaagttaatcatactacctattcagcgggtttaatgtatatgacagatttagggttagcaccttattttagctattctgaatcttttaggcctctttcaggtagtttagataatgctacaaacggttcatcaatttataagccttatgaaggtaagcaatatgaagttggctttaaatatttgccatcatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaatgggcagatttctgtggcttattttgacttaaaagagaaaaatgctcttgtcgcggctcgtagtggggatgtcaccacaatggctcaggttgaaaagcaaaaaaatcgtggtgtagaaattcaagctgatttaaatattactgaatcgttatctacttctttagcttatagctatatatttgctcaatcccatcgcttagataaacctcgtattgatactccattacaaccaaaccatacttattctgcattagttaattatgcatttaaggataatgtacttaacggcttaacattaggggttgcgcctcgttatactggaacaactccaacagaaatggatggctacaataatgccaatattcgcgttccagcaagaacactagtggatctgatggcgaaatatagcctttcagagaattgggagacaagagtaaacgtaacgaatgttgcgaataaaaaatatatcagtggttgtagttacgcttgcttctttggcgaaggacgtaaagtcactgcgaatttaacctataaattctaataatatctaaattaattggtgcgagtgtctagctcgcaccagtatttacagtgtaatagagaacatagtagctaagaataccaaaaatcatttttagctaccatatctctatttcttccaaatccgtgtctgataatcacgaatcgaacggtctgagctaaacatacccaaacgagccgtattaagaatcgcagattcaacccaagcggtttgatcttgataacgttttgcgacttctttttgagcttcacggtagcttgcaaaatctgctaacacacagaaataatctttgtttaacagatcataaactaatggttcaaaggtatctttattaccacttgagaatgttccgtccgctaatgcgtcaatcgctcgttttaatacaggatcttgctcatagtacgttttagacacataaccttttgcacgcaattcacgcacagattcaacggtatgtccgaaaatcacgacattttcttcccctgcaaattctgcaatttctacgtttgcaccgtctaatgtgccaagcgtaattgcaccattgagagctaatttcatattgcccgtacctgacgcttctttacccgcaagagaaatctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcaaggcttacacggtagtctggtaagaatgctacttgtaatttaccttgcatatcaggatcgttgttaatcacttttgccacagcgttgatggcttgaataatttgtttcgccataaagtaacctggtgccgctttacctgcaaagataaacaggcgtggtacaacctcttgttgtgggttcgctttaagctcttgataagtggcgatgatattcaacaggttcaaatgttggcgtttgtattcgtggaaacgtttaatttgaacatcgaaaatcgcattgcaattcacttttaaaccaagtgattgctcaatttctttcgctaatagctgtttgttttgctgtttgatgtgattgtaatctgcttggaactgtggatctttggcaaatttctcaatttgagccaacaattcaagatctttcgtccagtcacctttgatatatttatctaacaacgtacttagtaatgggtttgcttggcggatccaacgacgaggggtaataccgttagttacattatggaagcgacctttaaacaagcggttataagctgggaataaatcgcttaccactaaatctgagtgaatttgtgccacaccattgacagcaaaagatcctacaacacaaaggtttgccatacgcacacggtggttcattaagaccgctgtttcgtcccacgcatctgcaaattctgcttcgctaaattccgctttcacttgttgataaagctcgtggttaatgcgatcaatgatgattaaatggcgtggcaacaatttcgccacgagattttgatcccactgctctaatgcttcaggcaataaagtatggttggtgtaagcaaatgtttttgaacaaattgcccaagctcgatcccaacataaaccgtattcgtcaatcaaaagacgcattaattcaggaattgcaatcgcagggtgtgtatcgtttaactggatcacttcaaattcaggcaactgctctaaggttctaccttgtgcaaggtgattttttagaatatcggcaacagagcaagcacagtggaaatattgttgcattaaacgcaactctttaccttcttgatgattgtcgtttggatataacactttagtcaattttgacgcatcaaccactttgctttcagactcaagatagtcgccgtcgttaaattgagcaagatcgaaggacgtttcgctataaccttgccataaacgtaacggctgttgaacccctttataacccactacgggtaaatcaaaggcttcaccataaattgtccacgctggtttccattcatatttatcaccgtcacgatgccatacttcgccaccaaagccaacggtttgacgaaaatctgggcgatgatattgttgagtatagaaatcacggctccacgcatcgccttcttcacgttgttcacctgcccagccaaagctctgtttgaataagccgtactgatagtgtaatccgtatcccactgctggctgagcaaggcttgccattgaatctaaataacaggcagccaaacgacctaaaccgccgttacctaacgatggatcacgttcttcttcgagaatatcgactaaatttttaccatattgagctagggttaaatgcacatattgataaaccccaaggctcattaagttgttacccagtaaacgtccgattaagaactccattgagagatagtttactttgcgagtgtttacaagcggtgcgtttttagaaaaattttgcaaaatcgcctgttggctgacttcggcaatgaattgataccattgttgtgtagaaagttgttcaggttttaaaaaacgctcttcacagtagtttttcaacgactgttcaaacagcgtttggaattgttgagtagatgacatgaagactccaaataaaaattttcaaatagtatagagattatgaataaaattgcgagagttaaatcattcttttagaaatgaatggggggggacatcatagtatgacatgtttagaacggataaatgggatagatttttctctatcccatttaagataatttaaacatcttttgttttttctccagatttatcatcttgttcgggatcaaattttacaacgggtacacagcctcgacaagcaccttggtcaacgccaagatctttacataactctttgtatttctctaataatgtacgaaaaaaagatttagattcgctactcatatttcacctaacgaaataatgttctgtatgaagaagtttgcttgaattgacttataataataacagcaaaaacgacaatataaatagagaaaaccacaatcaaccattgtggcatagagagatctaaaaattgccagaccacttttccacaatcgcctttacctgtagcttcaaagagatctgggaaccatttgttcaatggcaatgtttcagggaaatctacaaaaggtgaacactggttccacggagcaggattgagttgataatccgtatgcttaattgcaaggcttaaaccttttattgagccaaataaaccaagcaataatgcaagccaacgtacgagcgttttgcggggggctaaaaagccgataatccccgcaattaaaatcgccaatagagctaatcgttcataaatacacattacgcaagggtttagtcccattccgtgttgaaaatagagcgcagcagcttctagtgctgtacagcttgcagtgagaagtagccaagcactacgacttattgatagctctttaaaataagttagcatacggttccctttatttttaacgagtgattaaccagccccactccgtcattaattttgttaattgtggcagtaaaaattctaatgcaaagaaccctactcctgataaaactacggtatatggtaatgccatatagaccattcgtccataggataaacgaattaatggtgcaatagcagaagtcaataagaataaaaatgcagcttgtccatttggagtagcaactgatggtaaattggttcctgtgttaattgcgacagcaatcaggtcaaattgttccctactaataatgccagcttggaaagccgcttttgcttcgttaatgtaaacggttccaacgaaaacgttatccgaaatcattgaaagcaatccattaaatgtatagaacagcaccaattgtgagcttggttcagcggacagaacaaattgaataattggatcaaagagtttcaaatctacaatcacggcaacgatagagaagaaagccacaagcaatgcggtaaatggtagcgactcttggaaagaacgtcctaaggcgtgttcatcagtgataccacagaaagctgtacagaaaataataacagagagaccgattaatcctacttccgctaaatgcaatgccaacgcaatgactaaccaaacaccagctatggcttgaataaccaatttcattcggtctcgttttgtcatctcttgttctttacgcaagttataatgggctaataccacccaaactttacgcggcaagcggtcaccataaccaaaaagtttgtatttttctacgagataacaggttgcaatacctgatacaagcacaatgatactaattggagctacccgtaagaaaaattccccaaatccccaatcagcttgagcagcaataattaaattttgcggttcaccgaccattgtcatcacgccacctaacgcactacctactccagcgtgcattaataagctacgcaagaaaccacgaaattgttctaaaatttgtttgtttgtaattaatttatcatttgaagcatcatcggactcatcatcgtccaaaagcccacctgatgcgaccttatggtaaactttatagaatcccattccaacactaataatcaccgcaattaccgttaaagcatcgaggaatgcagataagaatgccgcacttaaacagaaagtgagtgcaagcatttttttagaatggatggaaatcagtagcttagtgaatgcataaagtaacaagcgtttcataaagtaaatacctgccaccataaagatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacttcaaagttggcgagaatttcttttttgatatgctcagcactcgtcattccaatagcgacagcttcaatggcaagtagaccacctggttgtagaggataacattttaatgccattgctaacgtaaaaataaattcagccactaatgcccaaccagcaacaaatggactaatgaaaaaatagagcaatggattgataattaagaaggcaataatgcaagccttataccattctggtgcgttaccgagaaaatttttataaaaagcgtcaagattattcatagatttaactaaaaagtaaaaatgattgtggattgtaatctagtttagattaaacgataatagcccaagagccattatatggaaggcaatatcatttttgataagtacatcacactttttattatttatttgaagtatttcttcattttttgagataaatcaatgaatcaatcagacattttaagagcccaaagcccagcagcccttgctgaagaatatttaatcaaaagtatttggagtaaccgctttcctgctggttcagatttacctgcagagcgtgaacttgcagatattattggtgttacgcgtacaacgttaagagaagttttacagcgtcttgcgcgtgatggttggttgagtatccaacacggtaaaccaaccaaagtaaataatatttgggaaacagcgggtccaaacatcattagtacattaattcatttagatgagtctatcacacctacgattatttcaaatgttgtttcgttgcgtactagaatgggagaatactttattcccaaggcaattaaagctgatcatttagcttcttcgtcacttttaaaagatcttgaatcgcttcaagacacggcacaagcttatgctgaatttgactataagctatatcgggaatttacctttattgccaataagcctgtttatgggttgattttaaatagttttaaagatctctatttaaaaacggcatctttatttttctctaatcctagttctcgccaattaagttttgcattttaccaagcacttcgtaccgcttgtgaaactaatgattacgaaaaagccgtagaatgtttagcaatgagcagtcaacgtagtaccgaaatttgggctgaaatgttaaaaaacttaccgaaaaattttggtgaataaaactgctaaatagtaaattttatatcataaaaatctattgtgttttacaaatggagcattttccacatactgaacctaatagattatgctataattctatgtagggtattaacaatccaataatggaaaatagataaggaaatcgcccttatctattttccattattaatttaattattcgttttgggaggaagtatgaaaatcaaaacgtcactaatgtgggcaatttcggcatttttcgctgtaatgctttctgcttgtaataaagaaccccaacaaattgcctttgaaggtaaaacaatgggaacaacctaccatatcaaatatattgatgatggtaacttaacaaatttacctaaaccagaagaagttcaacgtcaaatggatacgttgttaaaaatggtaaataacgagatgtccacctatcaaaaagactctcaaattagccaatttaatcaaatgaaagaggcagataaaccgtttgaaattgcctctgattttgccaaagtggtcaaagaagcggtacgtctaaataaagtgacagaaggtgcgttagatgtgaccgttgggcctttcgttaatttatggggatttggaccagataaacgcctaaataaagcaccaacggaagaacaaattgcagaacgtgccacttgggttggtattgaaaaattagtcttagatgataatgctacaaaagccacattaacaaaaaaagtaccagagctttatctcgatctttcagcaattgccaaaggatttggcgtagataaattagcggattaccttgagcaattaggggtacaacattaccttgttgagatcggcggtgaattacgcggaaaagggctaaatttaaaagggcaaccgtggcgtattgcagttgaaaaacctgaatttgctcaaggaacatcaagtcaaattgttgtgccattgcataatttaggtatggcgacttcgggtaattaccgcaactattttgaagatgaacagggtaatcgcctatctcacattatcgatccaaaagcgttacgtccgattagccataacttagcctcaattactgtatttgcaccaaccacaatgactgcagatggactttcaacaggcttatatgtgttaggagcagaaaaagcactggaagtggcagaacgtgaaaatttagcaattttcttaattatcaaaaaaggcgacggatatgaaactaaaatgtcgagtgcctttgaaaaattaattaatcaaaaataataggacaaaaaatggaaacaattttactgacctttgctttctttgtagccattgtatttatgatgtcaatcggctttattatcaaaggtaaaacaattaaaggtagttgtggcggtatttctgcactaggaatgaaaaaagtctgtgactgcgatgagccttgtgataatttaaaagcaaaattagaagctggcgatgaagctgctaaagccgaatatgaagaaaaatttgccaagaaagaggctcagttttacgaagtaaaataattttttcatcaataggaaggaaaaatggagcaacaagatattcgctggaaacagcgttttgaaaattatcaacatgctgttgcttatctaaaagatgatgtagaaaagtatgcagatactgatcttgatattatcaaaaaagggattattcaaagttttgaaatcgctcacgaacttgcttggaaagtaatgcaagactatttgaaatatcaaggtcttttagatgcaaatggacctagaaacgtaactcgaatagcctttcaatatgagcttatttttgaggggcatcattggatggaaatgttgaatagccgtaatatgacagttcatacttatgatgctcaaattttgttgaaagaatttgaaaaaattgttcacatttatcttccccttttccttgcattagaaaagagaatgatggaattatggcagaaaagtttggattaaatgaacaatctattagggtaattactgatattctcaagaaataccccgaaattgagcaggcgattatttatggttctcgagcaaagggtaattatcggataggttctgatattgacttaacttttaaaggaccaaatcttaatcagagcatattgggtaaaatcaggctagatttagaagactctagcctaccttatctgtttgatctttcaatttatcacgaactggctcacgaaaattttattcagcatatcgacagagtgggacagcaattttatcaacggacagaacaacaataatgaaatcaaaaacttaccaacaacattttcctgcacttaccgatgaacaattagcggaaaatgcaaagaaaaaagtgatctgcggaatgtcgggaggagtagattcttcggtttcagcctttattcttcaacaacaaggctaccaagtggaaggcttgtttatgaagaactgggaagaagacgatgacacggattactgcacagcagcggcagatttagccgatgcacaggcagtttgcgataaactgagtatcaagctacataaaattaattttgccgcagagtactgggataatgtgtttgagcatttccttgcagaatataaagctggacgtacaccaaaccctgatattttgtgtaacaaagagatcaaattcaaagcctttttagaatatgctgcagaggatttaggggcggattttattgccacagggcattatgtccgtcgtccaccgcttgatcaacagccaaaattattgcgtggacttgatagcaacaaagatcaaagttatttcctctacactctgagcgagcaacaagttgcacaaagttttttccctgttggtgatattgaaaaaccgattgtccgagctattgcagaagacctaggtttagcgacagcaaagaaaaaagattcgacggggatctgttttatcggcgaacgtaaattcaaagatttccttgctcgttatttacctgcacaagctggggatattaaaaccgtcgatgggcaagtgattggtcgtcacgatggcttaatgtaccacaccttaggacaacgcaaaggtttaggtattggtggtgtcaaaggggcgagtgaaaatgcgtggtatgtagtggaaaaagatctggtgaataatgtgctaattgtcgctcaaggtcaggataattctgcgttgctttcaagcggcctgattgcaagccaacttcactgggtagatcgccaaccgatccgtgaaaaactacgttgcacagtaaaaacacgctaccgccaagcggatattttatgtgaaatccaaccgcttgatgacgaaaccattcgagtgatttttgatgaacctcaaatcgccgttaccccaggacagtccgccgtattttatcaaggcgaagtctgtttaggcggtgggattattgaagagcagctgaagtaatatctcctaatagtgatattgtggaagatagatttatggcataagaatggggataatagacaaatttgctgctaatatttagaaaaaataaacattagtaactagtttgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagatagaatcttctgctcaatccctttcgcatctaaccctaaatccgcataggattcggcttgcgtagcttgtgggataaagaaatcaggaatgcccaacattaatagcggtttgattttgccgatatgttgcaagtattcgtttactgcactaccagccccaccttgaagggcattttcttcaagggtgactaataattcgtggcggtcggcaagctcagcaatcaaggcttcatctagcggttttgcaaaacgcatatcaaccagcgtgtaattgtgggtttctgccacttgtttggcctcgtttaataatgccccgaaattgagaatagcgacctttttcccctgttttaacactttgcctttgccgatttcaagggtttgcatcggttgaagctcaacgccttgtgcattgccacgcggataacgcacggcaacagggctgttcattgtgtaagcagtgtaaagcatttgacgcatttcattttcatcacttggacacattatcgtcatatttgggacacaacgcataaaacttaaatcaaatgcgccttgatgggtctgcccgtctgctcccacaataccagcacggtcaattgcaaaaatgacaggcaagttttgaatagccacatcgtgaataagttggtcataagcacgttgtaggaagctagagtaaatcgccaccacaggcttgtaacctgcaatcgcaagccctgccccaaaggtcacggcgtgctgttcggcaatcgctacatcaaaatattgttgtgggaagcgtttagaaaactcaaccattcccgatccttcacgcatcgcaggagtaatgccgataattttcggatcacgctctgccatttcgcaaagccagtcgccaaaaatattggaataggtcggtgcggattttgtttgtggtaacttaccgcttgtgtggtcaaatttcggtacgccgtggaagccgatagggtcctgttccgctggggtatagcctttgccttttttggttttaatatgtaagaactgtggtcctgacatattacgcatgttnnnnnnnnnnnnnnnnnnntcttcaatatcatgcccatcaatcgggccgatatagttaaagccaagggtttcaaacattgtgccaacaggcgaaacaaagcccttaacgtgttcttctgtttttcgcacaaactctttgatcgacggaatgcctgagagcagttttttgcccccttcacgtaaagtaccataaagcgaaccagtgaaaaggcgagctaagtgattatttaatgctcccacattttctgagatggacatttcgttgtcatttaagataaccagcatattggtatgaattgaacctgcgtggttaatcgcttcaaatgccatacctgcagtgattgcgccatcaccaatcacacagaccgttttacgccctgcgttctctttttctgcggcaacggcaatgcctaaaccagcactaatagaggtagaagagtgtccaacgctcaatacatcaaaaggactttcttcacgccaagggaatgggtgtaagccgtctttttgacgaatagtatgcatttggtcacggcgacccgttaaaattttatgtggataggcttggtgtcctacgtcccagataagttgatcgaatggggtctgataaacataatgcaaggcaacggtcaattcgaccacgcctaatccagaggctaagtgaccgcttgtttgactgacggactctaacaaataggcacgcagttcatcacaaagaggttgaagtttatcttttggtaataaacgcaaatcatcaggtgagttgatttgactgagcaatggataggtcttttgcataagcttatctttaatcgttgggtgggcaactgcccatcaaaaaaatctattattaggctttgagttcttcagttaaggtcggttgaatactgtttaaaatttcttttacaacacgaccgctacctgccactacattacctgattttaagtaatctgtaccaccaacaaagttggtcactaacgcacctgattcacgggcaattaaatcgcctgcagcacaatcccacggttttaatccgatttcaaagtaaccatcaacacgaccagcagccacataagctaaatctaatgctgcagaaccagtacggcggaaatctgctacgccattgttcatcaaggcttcaatcatatttaagtgagcagtacgatgttttgcgactttaaacgggaaacctgttgctaacactgtgccttgtaaatcacgacgttcattactaatgcgaaggcggaattcatttaattttgtaccttcgccacgcacagcggtaaataattcgttacgaataggatcatatacaacacccacctcagtacgaccattcacacgaatagcaatcgacaccgcaaaatgtggcaagcgtttaacaaagtttgttgtgccatctaatggatcaatcacccattgtacatcgttatttgtgccagctaaaacgcctgattcttcgccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacgcctgattcttcgccaacaatagcatgatcaggatacgatttacggatcacttcaataatggctgcttctgctgctttatcaatttcggtaacatagtcatttgcgcctttttgagcaacttgagtgtcttgaggcgcttgctcatagcctttagcaataatattgcctgcttttcgtgctgcacgaatagcgatatttaacattgggttcataattccaccagattttaaagaacgtaagaggattaggattatagagaaagttagggaataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatagagaaagttagggaataaaggaatagggcgacgagatcaatttgttttaaataagattttatctggtgttgtgtagcagctgcacaacagctaattttaagaaaagttatgtaagaggggattttcgcttgtttcctcgttagattggtcaaaggcaaggaaatagagatagaaggggatagtccctatccctacaatttaaaactggctttcaactaagatattgacgtttttatccgtacaggaatagagcgttggcaaattactattttgcttacgataggtaaattgtagccctaggtgttactcctaaccaataccaattacgcttccatagcgttaaatttaagctatatactttgtcagaacgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacccgaatacaaggcaggttaccgatgaacgctccgatttattgtggtattgatgttgctaaacgcaatttcgtgattggyttttctcatcagaaaaagaccaaaaccgaaaccaataacgcyaaaggtattcaacataccttggactatttaagccagtttaatgtggctctgataacgcttgaagcaacgggtggattagaaatycccgtggcaaaagcccttgctcgagcaggttatcgtgtatttattgctaatccactgaaagccagtgagtttgcaaaatctcaaacgagagccaaaaccgatgcaaaagatgcggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttgtctaaattgatgattccaccgaactctgtttttcatgtaaataagcttaaaaagctctcctattgtaaaaacgtttacaagtaaatgtactgtgttttacaacaattacaaatgttttcgtttgcttgattttgaggcaatgtaaagaagtttgttgtttttgctgcgggtaatgaattctatttataattaaatatattcgtatttttctgacaaatttcttgcccctaatctacgaaaactataaaattctccaattaaagtgggaaaaagtggtgttttgtggaattttttccaaatttccgaatctctaaggttaagtgagcaaaaaaatgtttcgtggagcaacttcaatcagcattgatagcaaagggcggatcgctattccgacccgttatcgtgccgagcttttggagagttaccacgggtcatttgtttgtaccgtagatattcgccagccttgtttattactgtatccgttgcacgaatgggaaattgtcgagcaaaaattgctcgctctgtctaacttcgatcctgcacagcgtcgtattcaacgggttatgcaaggttttgcgacagaatgtgaaatggattctgctggacggattttacttagcccgactttgcgtcagcacgctcaattagaacagcagattatgttggttgggcagttaaataaatttgaaatttggcaagatcaacaatggcagaaacagattagcgaagatcttgcaattggtagctcagaagaaatgcttcattgtgaggcattaaagaacctttctttataacaataacggataatcaaaatgagtgactcacccaaacatattacggtgttattacacgaagcagttgatggtttagccattaaacccaacggtatctatgtcgatggtacttttgggcgtggtgggcattcacgtcttattttaagcaaattgggtgaacaggggagattgattgcaattgatcgtgatccgcgtgcgattgcagaagcgaataccatcactgatccccgttttcaaattgttcacagtgctttctcatccattcctgatatttgtgacgaacttaatttagtcggcaaaattgacggtatcttactcgatcttggcgtatcttccccacaacttgacgaagcagaacgtggttttagttttatgcgtgatggaccattagatatgagaatggatactactaaaggcttgtcagcaatggagtggttagcacaggtgtctgttgatgatctcgcttgggtgttaaaagagtttggcgaagagcgttttgccaaacgcattgcacaagcggtcgtttcttacaataaatctgcaactgaaaaaatttcccgtactttgcaactggcacaaattattgcagatgccgtgccgtttaaagataagcataaacacccagcaactcgctcttttcaggcaatccgtatttacattaatagtgagttagatgaattagaaaaggcattaaattcagccctaactgtactcgcacctgaagggcgtttgtctattatcagcttccattctctagaagacagaatggtgaagcagtttatgcgtaagcagagcaaaggcgaggcggtgccgaaaggtctgccgattttagaaagtgagttaaataagaatattcctttaaaaaccgtcggcaaagcgattatgccaagtgaagcggagattgaagccaatccacgctcacgcagtgcggtgttaagagttgcggagaaaagataatgtcgagtgaacgctatcctttacgtcaagtgattttagacgatttaactagccataataaagtggcgttattgctacttgttggggtggtgattagtgctgttgcaacgatttggattacgcaccaaacacgtttattaacagcagagcagggaaaattattgcaagtaaaacagaagcttgaaaatcagtatgttcatttgcaattagaagaaaattcaaaaagtcagaagtttttagtcgaagctgttgctgaaaaatttggattacaaccagttaaaaaagaacaagaaatcattttagtggaataaaaatgaaaaaatcagtgaaatataaccctaaaaataaaaatacgatgggagatgaattaaaagaggtagatatttctccccagcctagttttttgcctgcccgatttggatttgtttatctgtttatcggtgtaatggcctgtgccttgatcggtcaaagttttttcttacaagtcactgattcagaacgtttaatcaaagaagcaaatgatcgctctttacggacaaaagagcttccttttacaagggggaaaattttagatagaaatgggcgagtgctttcaattagtgtgccgatgtattcaattacgattgatcctaaagaatattttgatactaaacttcgtcgtaataaatcgttatggcgagttttggctatggaaatggaggcttcagccagtaaaattgaagctagtgtgaatcgttttattaaagaaaaaccacagaataaagaaaataaatatgatcctagagcgattttaaacaataaaagtgaggattattggacattactcgctcgtgcaactgcattagattacaacgtattaattcaacgcatacgcaataatccaaattctatgtttttacatttggaaaatgagtatgctcagcttgaacgccaaaaaatgcaagagttagccaaagcattaggtatgaaatacagcgtaatgatggataaactttatgcttcagcaaatcaacgttttttatatatttctcgtcacgaatcagatgtgataggagattatgctcgagcattaaaaattgatgggcttgtattaaaagcagaaactcgccgtttttatcctcttgcagaagaaatttcccaattaatcggctttaccgatgttgatgataaacaaggttcggaaggaatagaacgtagttttgatagcttattagtgggtaaaaacggtaaacaagtcattcgtaaagatgcccgtggcaatgtgattgagcatattcgcgatgagaaaaaatatgatccgcaagatgtgatgttgagcattgatgaagaacttcaatcgatggtttaccgtgaaatcaaaaaagcggtaattgaaaataaggcagaatcaggaacagctgttttagtggatattcaaacgggtgaagtgttagcgatggcaaatgcaccatcttttaacccaaataaccgtgcagaattcaaatcagaattagcgcgtaaccgagtgattaccgatacttttgaaccaggttcaacagtaaaaccactggtggtattgacagcgctacaaaataaagtgacttatccaagtgaagtcattagcacaagaccttttgtcgttaatggacatacgattaaagatgttgctcctcgcgatagtttaacgctgacggggatcttacaaaaatccagtaacataggtgtaagccgtttagcgttaagaatgccatcaaccgcattagtcgaaacttatagcaaggtcggttttggtaaagatacaggcttagggcttggtgaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgtggtacaaacggcgatcgtaaacgttgggcggacattgaacgtgcgacaatggcgtatggttatggtttaaatgtaacgccattacaattagcccgagcttatgcaacattaggtagctttgggatttatcgtccgctttcgattacaaaagtagatccgcctgtgattggtgagcgtgtgcttcctgaaaaaattaccaaagatgtggtgcacatgatggaaagtgttgctgctaaaggcgaaggtggggcaagagccgccgttgatggataccgtgtggctattaaaacaggtacagctcgtaaattagaaaaaggcaaatatgttgaaaaacatattgcttatacagcaggtattgcacctgcgagcgatcctaaatttgctttagtggttttaatcaatgaaccaaaagctggggcttattatggcggtgcagtatctgccccactgttctcaagtattatgggacatactttaaaagcaagaaatattaaaccagataatcttactgaagatacaaaaagtgcagtgagagagatgaaaacaaattcgacaaactaagaggcaataatgaaccctttactttcctttttccctgaacttaaccattggggcgaattaaaagaattaaacaaaatgaccttggacagccgtcaggttgaaaaaggcgatctatttgttgccttaaaaggacatcaagtcgatggtcgtcaatttattgaaaaagcgattgaacaaggtgcttctttagttttagctgaagcggacgatgacgttcaagcggtgagatttgcagaaaaatttgcaaattcgaccgcttgtgtactggaagtaccaaatttaccgaaacaactttcggcgatagcaggtgccttctatggcaatccatcagaaaaattaacccttgtgggtattacaggcactaacggcaaaaccactacggcacagctttttgcacaatggcgaaacttgcttggcggtaaatctgcggtgatgggtactattggcaacggactatatgggcaagtgcaagaagcggtaaataccacaggttctgccgttgaaattcaatgcaatctggagaactttgttgaattaggggcggatttctgtgcaatggaagtctcttctcacggtttggctcaatatcgtgccgaagcgctagactttgacttggcgattttcactaacttaagccgtgatcaccttgattatcacaacacaatggaagagtacgcccaagcgaagttccgcttatttggcgagctttcttcaaaacaacaagtaatcaacgctgatgatgaaatcgggcgtgaatggttggtaaaattgcctgaagccgtcgctgtcagcaccgacagtcagttccaaccacaacaagcccgttggattaaagcgaaagcggtgcaatttaccctacaaggtgcaactattgaatttgaaagtagctggggtaatggcgaaattaaaagctgtttaatcggagcgtttaatgtcagcaatttattaaccgctttcgctggtttattggcgttgggctacgatttgcaaaaattagtcgaaaccgcaccgctgttaaacggtgtatgcggacgtatggagtgtttaatcagcaaagaaaatgcggaagaaagcccgatggtgattgttgattatgcccatacccctgatgccttagaaaaagccttagatgccgctcgtttgcattgtgaaggcgaactatggtgtgtgtttggttgcggtggcgaccgtgatacaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcgaccgtgatacaggtaagcgtccgctaatggctcgtattgccgaacagttggcggacagagtgattgtgactgatgacaacccacgcaccgaagatcctgatgtgatttttaatgatgttatgaaaggtttccgtaagccaaaagcggtgcagtctatgcatatccgtcaatatgcgattgaacaagcaatcgcccaagccgaaccaaaagatgtgattttgattgcaggtaaaggacacgaagattaccaaattatcggcacgaagaaatatcacttttcggatcaagagtgggcgaggaagtttttggggtagttggaatttaatctattgcacaaaataatttgtaggggcaaattacatttgccccaaaagcaatcataaggaagaggggctaatgtaattagcccctacaaaagtagattttaaatagtaaaaataatttataagtaaataaagatgataaaacaaaccacccaacaactcgctcaaaccctaaagggtaaactactcggtagtggcgaggttgttgttgaaaacatcagtacagacacccgtcaaacggttgaaaaaggcttattttttgccttaaaaggcgaaaaatttgatgctcacgattatgtagaaaaagcgatagaacaaggctgtgtggcgttagtcgttgagcgtgaattggcggtgaatgtaccgcaaattattgtggaagatactcgcttggcattagggcagttagcaaaatggctgaaagcggaaattaacccaaaaactgtggcaatgacgggctcttcaggcaaaaccaccgtcaaagagatgactgcaaaaattttgcaaaaagtaaccgcttgtgaagatcaggtgctttatacttttggcaatttaaacaatgatttaggtgtgccattgaccttattacgtttaacccctgagcataaatttgccgtggtggaactgggggcgaaccatatcggcgaaattgcttacaccaccgaaatagcacaacctgatgcttgtttagtgaataacgtggcatctgctcatcttgaaggatttggttcattggctggcgtggctcaagccaaaggcgagatttatcgtggcttgaaaacaggcggtaaagcgattgtgaatttagcccattactaccctgaatggcaaaaagagattggcgatcacgagttgcaatcgttctgttacacaggcgaagataaagacagttatgtagatttttgggcggaaaatgttgaactacatcttaatggttcacgctttactttgcataccccacaaggcgaaattgagatcaatctgccttatttgggcgaacataatgtaagtaatgcgttagcagcaacggcactcgcaatggcagtcggggcggatttaactgcggttaaagctggattagaacagcgttcagcggttaaagggcgtttgtatccgattgaaattaaagagaatgtgctgtttattgatgacagttataatgcaaacgtggattcaatgaaatctgcggtatcagtgttaaaacagtatccggctttccgcatttttgtggcgggagatatggcggagcttggcaaagacagccctgcttgtcatcaagaagtcgccgatttcgttaaacaggcgaagttagatttagtggtcagcttcggcaaagagagtgaggtgattagcggtaattcagctcaccactttaatgacaaaaccgcaatggcggcgtttttgcttccgattattttgcaaaaaatcgagcaaaaccaaccgcttgttcttttggcaaaaggctctcgtagccaaaaaatggaagaggtaattgcttccttatgtcgttcttttgatgtttctttttaaggattagcttatgttagtgtggcttgctgaatatctggtgcaatacaacacagcgtttaacgtggtgtcgtacattactttccgttccattatggcgttattgacggcgttaattatcggcttatggattggatcgacggtcattcgccgtttacaaattctcaaattcggacaggaagttcgccacgatggccctgaaagccactacaaaaaacggggcacgccaacgatgggcggtattatgattttattcgctatcggtgtgagtacgttgttatgggcggatctacgtaacccctatgtctggtttgtgctatttatcctatttggctatggggttgtcggttttgttgatgattattggaaaatcgctcgtaaaaataccgatggcttgattgctcgttggaaatatttttggttatcggtgatcgccttagtgtccgcttttggtatgtatgcgattggtaaagataccgcggccacccagttagttgttcctttctttaaagatgtgatgccacagctcggcttattctatattgttctaacctattttgtgattgtcggtacaagtaatgcggtgaatttaaccgacggcttagacggcttggcaatcgtgccgcttattatggtcgcaggggcatttgcattaattgcgtgggcaacggggaactataattttgcacaatatttgcacattccttatatcaaatatagcggtgaattagtgattttatgtacggcgattgtcggggctgggttaggtttcttatggtttaacacttatccggcacaagtttttatgggcgatgtcggttcactgtcacttggcggtgcattgggtgtaattgccgtgttagttcgccaagaattattattagtggtgatgggcggtgtatttgtggttgaagccttatcggttattttacaggttggctcttacaaactccgccaaaaacgtattttccgtatggcaccgatccaccaccactttgaacttaaaggctggccggaaccacgtgttatcgtgcgtttctggatcattaccttaatgttagtgttaattggattggtgacgttgaaattacgttaattaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacactgcgtgtgtccgttacagttttaccaatcgaggaataatgaaaataaagcggacacacgcagtgtgtcnctacatctgaaaataccgtttctagagaacaacaaaatgcaaaatcaatatcaaggcaaaactatcacaattatcggcttaggcacaacaggcttatcttgtgtcgaattttttgcggacaaacaggctcaagtgcgagtgattgatacccgtgcaaatcctgctggggtagataaattatcgagggatattccactgcatacaggcagtttaaaccttgagtggttattaagttctgatttaattgtgattagcccgggacttgctttagcaactgctgaaattcagcaagctattcaagccggtgtggaggtggttggcgatattgagttgttctgtcgtgaagccaaagcgccgattattgcgattacaggctcgaacggtaaaagtaccgtcacgactttgacgactgaaatggcaaaacaagccggagttaaagttggaatgggtggcaatatcggcgtgccggcattgagtttattgaaaggcgattacgagctttatgtgttggaattatcgagttttcaacttgaaacgacctattctttaaaagcaaaagcggcgaccattttaaatatcagcgaagatcatatggatcgctatgagagcattgaagattatcgccaagcgaaattgaaaatttatcaccatgccgaaaatgtaattgtgaatggcgaagatccgcaaactttccctgaacaagcggtcggatctttgaaaaaatttgcagaaaaagacgcagaatataccgcttgtaatggagaactctattctggcgatgaagccgtcattgcgattgatgagctgaaaattactggtcgccacaatgtgatgaatgccttagcatcaatgtcattggcggaagctacaggcgttgatcgttcgggtattgtgaaagcgctacaaagctattcaggattagatcaccgtttccagctagtaccgacgaatgatggcgtacgctggattaacgactcaaaagccacgaatgtcggcagtactgtggcggcattaaatggtttgcaagtcgaaggaacgctttatctgttgttgggcggtgacggaaaagatgctgatttttctgagttaaaaccttttattaatcaaccaaatacagtctgttactgcttcggaaaagatggggcggaactcgccgctttaactccaaatagcgttttagtggaaacaatggcacaagctgtcgcacaaattcgtttaagattaaaagcgggcgatatggtgctactttcaccagcttgtgcaagtttagatcagtttaaaaattttgaagagcgtggcagacagtttgtggcgttggctcaaggggttatctaatgctagaaaaaattcggattgagtgggataagtggacaagattaacgcctgttaatgcactctatgatcgaacattggtgtggttatttctcgcattgctgatcattggatttgttatggtgacttcagcctctattcctgtgagtagtcggctacacgaagatcccttctattttgcggtgcgagatggtttttatgttatcgcatctatttgtgcttgtgctttctttgttcaaattccaagtaaatattgggaaaagtataatggttggttatttatttcagccctacttttgcttgcaattacattgtttgttggaaaaacagtaaatggagcaacacgctggatccctatcggtcctattaatttccagcctgcagaattagcaaaatttgcggtgatttgttactttgcgagcttctatgtaagaaaatttgatgaaatacgacaaaaaagcattagtttcattcgccctatggtaatcctgattttatttagctgcttgttgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctcaacctgatttgggaagtatagcggtgctttttgtgctgacatttgcaatgctttttattatgggggcgaaagtcttacagtttatttttcttggtatcacaggcgttgtagtctttgctctattagttttaacatcggaatatcgcttaaaacgcgtaacttcttttatggatccttttgctgatgcttatggcgatggtttccaactatctaactcacaaatggctttcgggcaaggtgagatttggggacgaggcttgggtaactccgtacaaaaattagaatatttacccgaagcacacactgactttgtaatggctgttattgctgaggagtttggattagttggaattgttgtcgttgtgctattattactcgctttaacttttagagctttaaaggttagtcgggaagcgttaatgttagaagagcgatttaaaggtttttttgcttttggtattgcaatttggatttttattcaaggctttgtaaaccttggtgttgcttcggggttactgccgaccaagggcttaactttcccattggtaagctatggtggttcaagtttagtgattatggcgattgcaattgcggtattaattcggattgattacgaaaaccgcttggatcgaattggtcatgcacatttcagcgatgattaatattggaaaataatatgacaaaaaaattattggtaatggctggcggaactggcggacatgttttcccggcgattgctgtggtaagagaattacaacaacaaggctgggaaatccgttggcttggtaccaaagatcgtatggaagcagatcttgtgccaaaacacggtattccgattgagtttattcaaatttcaggattaaagggcaaagggatcaaagcattacttactgccccttttgcgatcttaagggcggtacttcaagcgaaaaaaattattaacgcgtacaagcccgatgcagtactcggaatgggcggttatgtatccggacctggcggtattgcagcgaaattatgtggtgtgcctgtgattttgcacgaacaaaatgcggtggtaggtttaacgaatgtatggctttctaaaattgctcgacgtactttacaagcatttccaacggcgtttccaaatgcggaagtggtgggaaatcctgttcgccaagatctatttgaaattgcaccgcctgaacaacgttttgctgaaaaaggctatccgatcaatatcttagtgatgggcggtagtcagggggcattggtgatcaataaaaccgtgctggaagtagcgaaagtgttaggacaaaacgtatttattagtcatcaagtcggcaaaggcaaattagccggtgtggaagaagtttatcaagcaacaggtaacggcattgctagcgaatttattgatgatatgaaagccgcttatgaatgggcggatttggtgatttgccgttctggtgctttaactgtatgcgagattgctgcagcaggattgcctgcgatttttgtgccgtttcaacataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaagatcgccaacaatttttaaatgcagagtaccttgcacaagtaggtgctgcaatgattattgaacagcaggattttacccctgaaagtttattaaaagcattagagccgttaattgccgaccgtcaaaaactgacggaaatggcaataaaagcaagagcgaaagccacaccattagccgcaaaacgagtggcagaagtgattgtggaaaatagtttgtaagcggtcagattttgtagtttttttgcaaaatgatcgaatataaggaataaaaatgaaaaatttccaagataaagttaaaaaattagtcgctgaaatgcgccgtgtaaatcaaatccactttattgggattggtggcgcaggtatgtctgggattgctgaagtattattaaatgaaggttatcaaatttcgggctcggatattgctgatggtgcagtcacgcaacgcttagcaaaagcaggtgcaaaagtttttatcggacatcaagctgaaaacattgaaggggcaagtgttgttgtggcttccagtgcaattaatgaaagcaatcccgaagttgcggctgcaaaagaagcacgtattcctgtgattcaacgtgcgcagatgttagcagaaattatgcgtttccgtcacggtattgcgattgcaggaactcacggtaaaacgaccacaaccgcaatgatttcaatgatttatacggaagcaggattagctcctacttttgtaaatggtggtttagtaaaatcagcgggtaaaaatgctcatttaggtgcaagccgttacttaattgcagaagccgatgaaagtgatgcgtcattcttacatttacagccgatggtttctgttgtgaccaacattgaaccagaccatatggatacttacggtggcgatttcgagaaaatgaaagaaacctatgtacgtttcttacgcaacttaccattctacggtttagcagtgatgtgtgctgatgatgaaacagtgatggaaattgccccaaaagttggtcgccaagtgattagctatggttttagtgaaaaagccgattaccgtattgaagattatcaacaaacaggcttccaagggcattatacggtggtttgcccaacgggtgagcgtattgagatcttactaaacgtgccgggtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggtaaaaataatgagcttaaaaaacgaaaaaattgcggtgttatttggtggcgtttcagcagaacgtgaggtttcgcttaattcgggcaaatcggtgtttgaagcattacaaagtttaggttataacgttgaagcgattgatacaaaagaatttccgattgaaaaattaaaagaaaaaggcattcagcgtgtatttaatattcttcacggtggtattggtgaaaatggcgtgcttcaaggggcgttagagcaactcggtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagcaactcggtattccctatacaggctgtggcgtaatggcttcggcgattactttagataagttccgcaccaagctattgtggaatgcagtgggcttaccaacagcggcaatggaagtggtacgccgtgggcaagcggtcaactccgatgaaattattgcaaaattaggtttaccattatttgtgaaacctgcgagtgaaggctcaagtgttggcgtaagcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagttattacctgcaatcgaagaagcattaaaatatgattcaattgtgttggtggaagaaaatttagcaggggcggaatactctgtgccagtacttgatggtgaagtgttgcctgcggtgcaaattattccagacggcgagttttatgactaccacgcaaaatatatttcggataatacccagtatgttgtgccagcgttaaatgctgatcgccaagcggaagtcgctaagttagtgaagcaggcttatgatgtagtgggctgtcgtggttggagccgaattgatgtaatggaagatggcgaaggaaacttccgtttagttgaagtgaatacttgcccaggtatgaccagtcatagtattttcccaaaatcagcggcgactgtgggttatagtttcgagcgtttagttgagcgtgtattggagttaagtgcgtaatggttgcggtaatacgtaagaaaccgacttcggtaattcgtacacaagcaagtaagccgaaatatccgattaattggtttgtttttgttaagcctatcgttgtgttattatgtttcggtatggtttatgcaatttataccaattggtctagtttgcttgcatcactggatagaacgccaatccgttcttatgcattaacgcataaaacacaatttacgacgaataatgatattcgtgaagttttagctaaagaacccttgttaaaaggctattttgaacaggatattcaagaaattaaagagaaatttctaacaattccttggatcagtaatgtttctgtgagaaaagtttatcccgataaattaagtattacgttacttgaacatcgtccaatggctgtatggaataatagtcagtatgtttctgaacatggagtagtgttcagtttgccgaaagataggtttgataacacaggcttacctattttatacggaccagacacagaaagtaaggttgtgcttgaggcttgggataaaataaaagcagatttaaaatcacgtaatttaggattatattccattgcaatggatagtcgaggagcttggtcaattcgacttgataatggcgttgaactaaaattagggcgaggggaatggctatcaaaaatcgatcgttttgtgactatttttcctgaaattgatattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcctgaaattgatattcctgaggggaaacgtttatcctacgtagatttacgttatgaacacggggcttccgttggatttaataatcaataatttattaacttgcaaacataattaatatgacaaaagtagcagaatctagaattagagtaggtttagaaattggaacacacaagatagttgctgtggtaggtgaggtattgcctgatggggtgattaatgtgattggctctggaattagcccgtctaaaggtgttcaaggtggtggcgttgttgatttagatgctgtaacaagtgctattcaacgtgcgattgaagaagctgaatcgatttctggatatgatattgtatgtgttactcttgccctttcaggatctcacattacagcttttaatgaaagtggaactgtgccgttgtctggtagtgtaagaaatgaagatttggataatgctattcatattgctcgttctattaaattacccgatgggctggaaacattacacatcattcctcaggaatatagagtagatagattacctgctactaaaaatccccttggtttatctggtatgcgtttgcaggctcaagctcatttaattgcttgtcataacgattggctacgtaatttaaaaaatgcagtggagagaagtaaattaaaaattgatcaaatcgttttttcggggcttgcttcaagttattctgtgttaacagaagatgaaaaagaacttggggtttgtttaattgatattggcggtggcactatggatgttcttgtttatacagatggtgctttgcgttttagtaaagttattccttttggtgggaataatgtaacggactatattgctcatgttttcacaacctctcgccaagatgcagaaaatattaaagtacagtatggatgtgctattgcacccccaactcattttccagagaaaaaaattgaggtggcaggcttgggtggacgaatgccaagaacttttacaaaaagccaattatctaatgttacatctcaatgctaccacgatttactgagcgtaattaatcaggaattatcccaattacgcaatgaactatatcaaaaaggcataaaacaagaattaattgctggaattgtattaacaggtggtggctctcaggttgaagatattgtagaatgtgcaaaatctgtctttggatctcaagttcgagttggtaatccattgaacattacaggattaacggattatgtaaacaaaccttcttatgcaaccgtattaggattgctacagtatagtcattataatgacgttgatagtagccaaagtggagaaattagtcataaggtgggcggcattattgatacattaggtcatagtgctaaaaaagcgtataattggataaaatcaagtttttaataggcattaataacaatattaagccgtgagggagaatcacaaatgtttgaacctatttatgaagcaacgcaagatgcggttatcaaagttatcggtgtcggtggcggtggtggtaacgcactaaatcatatggttagtaaccaatctgatgttggtagtgttgaattcttttcggttaatacggatgcacaagtattacgtagtagtgccgttcgcaatacgattcaaataggtgcaagtgtaacaaaaggcttaggggcaggagcagatccaaacattggtcatcaagcagctgaagaagatagagaagcattaacgaatatgcttacaggtgctgatatggtcttcattgctgttggtatgggtggtggcacaggtactggtgcagctcctgtaattgctgaaattgctaaaagccaaggagcattaacagttggtattgttactaaacctttctcttttgaaggtagaaaacgttctaactatgcggaacaagggatccgtgaacttgcaaaacatgtggattcactcatcattatccaaaatgataaattactaaaagtattacctaaaagtgtaaaatttaatgaagcctttggcgttgcaaatgacgtcttacgcaatgcggtattaggtattacggatatgattacttccgaaggtcttgtgaacgttgactttgcagacgtgaaaaaagtgatgtcggaaatgggtagagcaatgatgggaacaggcattgcagagggtgaaaaccgtgcagaaaatgcagcaaaagaagctgtagcaagcccgttattggaagatgttgatttatcaggtgctaaaggcattcttgtgaatatttcttctggctatgatattgaacttgcagaagtcaataccattatggaatatgttactagcttcgcagatcctgatgcagctattatttttggttctgcattctatccagaaatggatggtaagatccgtgtaacattggttgctacaggtatcggacaaccagaagaaatgccaaaaattccaagtgtgcaaggaagaaccgatattccgcaacaatctattattaataacggatttggcggtgctcgtcagcctgaatttataaataatatgggcggttacccaaaccaaaaccaatatacaacgcatcaaatgtctcagcaaccacaacaggttcagcaaacagcgccaagaccacagaaagttgatacagcgcaggtcttttcgccgaactcaatcccagggtttatgagaaatggtcaataaccatttcgggaaataaggaaacgatatgattaaacaaagaacccttaaacaagcagcaaaagtaacaggtattggcttgcacagtggcaagaaagtaaccttaacgttgcgtccagcacctgcaaatacagggattatttacgcaagaacagatcttaagcctgtcgtttatttccctgcaagtgctgaatctatccgtgatacacaactttgtacttgtatgatcaacgatgaaggtgtacgtatttcaacagtagaacacttaaatgcagcaatgtctgcgttaggtttagataacctaattgtagaagttgatgcagccgaaattccaattatggacggtagctcaagtccttttatctatctcttattagatgcagggattgaagaacaagatgtgccgaaaaaatttattcgtattaaagaaagtgtacgagtagaagaaggggataagtgggctgagtttaaaccttatagccacggtctgaaattagactttactattgactttacgcacccaatgattaccaaagaagtgcgtaactacaaaatggaattttcagcacaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactttattcaacaattaagccgtgctagaacctttacctttatgaaagatgttgaatatcttcaatccattggtcttgcattaggcggtagtttagataacgcaattgttttagatgaataccgtattttgaatgaagaagggttacgttttaaagatgaactagttcgtcataaaatgttagacgctgtcggtgatttatttatgtgtggctacaatattttaggtgatttcaaagcctataaatcaggtcacagcttaaacaataaattattacgagctgtgttagcgaatgaaaatgcttgggaatttgtaacctttgatgataaagcagaggttccgcaaggttatcaagtgacagaacaggtgtttatttaatagttattatcatttctcggagatttttattaaatttttaaggtgttttttcttaaaattctaatttttaaaaatttttgcagaaaaattgccgcttgctattcccttattctacattttcggctaatctcgcagacttcatttaccttggtaaatgaagtcttttttatttgtcttacaggaaattttatgagtaaccaatctttatcttcaaaaatccttggcggtaatttagtattacgcattgccgtaggtttagtgctaggtatctgcttagcattagttagcccagatgcagccaaaagcgttggggttctcggacaattctttgtaaaatcattacgtgcaattgcaccgattttagtttttgttcttgtaatggcttccattgctaacaaagaagttggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgatagccgcttaaaacctatcttagtgatgtatgtcttaggtactttcgttgcagcagtaacagcggttattttaagctatttatttccaacgacacttgaacttgttaccagcccggaagggcttgcaccgccacaaggcgttggtgaagtattaaaaaccgttgttttcaacttagtcgataacccacttggtgcaattacgaacggtaacttcatcggtattcttgcgtggtctatcggtttaggtatcgcattacgccacgcagcaccaagcaccaaagtcatgttaaacgacatctctgatgctgtttctttcgtggtaaaagtggtaatcgcctttgctccaatcggggtgttcggcttagtagcagaaaccatggcaaccaacggtgcagatgcctttatcggttatgcacgtttattagcggtattgttaggtgcaatggcaattgtggcatttatcctaaacccattattagtgtattggaaaattcgccgcaacccatacccactcaccatcacctgtttacgtgaaagtggcgtgacagcattctttactcgtagctcagcagcgaacatccctgtaaatatgggattagcgaaacgcttaggtatcaaagaagagatttactctatcgcaatcccacttggtgctaacatcaatatggcgggtgcagcgattactatcaccgtattaaccttagcagcagcttacacccaaggtatcgtgccggatttctcaacagcggtattattaagtattgttgcttcaatctgtgcttgtggtgcatctggtgtggctggtggttcattattattaatcccacttgcatgtagcttgttcaacattccaaacgatgttgcagcacaagttatcggcgtaggtttcatcattggtgttatccaagactcagctgaaacagcacttaactcatcaacggacgtattatttaccgcagcggtaagtatgtctgatgagaaaaataactagaattcttgtatacttttaatagttaaacactagtaaaagacttaactacatcagtcaagtattttagataagcagaaaaatagctgctataaaattgactatagccttatattgaaggctatagtcgtttactaggtctagatttttctctattttataaattttcattctaatattctcctttccttttccctttcctgtaattttcaggtacaatccgccgattatttttcttttatcaataacaatacaataggacatttactgcccttatgaaaatgcagaacattcgtaacttttctattattgctcatattgaccacggtaaatcgactttatctgaccgcttgatccaaacttgcggcggtttgtcagatcgtgaaatggaagctcaagtgttagactctatggatcttgagcgtgagcgcggtattaccattaaagcacaaagtgttaccttaaattatcaagcaaaagatggtcaaacctatcagttaaactttatcgatacgccaggacacgttgacttctcttatgaagtttctcgttccctagccgcctgtgaaggggcgttgttggttgttgatgctggacaaggggtggaagcacaaactcttgctaactgttacacggcaattgagatggatttggaagtggtgccgattttaaacaaaattgacttgcctgcggcggatcctgagcgtgttgcagaagagattgaagatattgtcgggatcgatgcgatggaagcggtgcgttgctcagcaaaaactggcgtgggtatcgatctcgttttagaagaaatcgtggcgaaaattccagcccctgaaggcgatcctgatgcaccgttgcaagccttgattattgactcgtggttcgataactatttaggcgtggtttcccttgtgcgtgtcaaaaatggggtgttgaaaaaaggcaataaaatcaaagtgatgagtacaggacaatcttatcaagtagatcgtcttggtattttcacgccaaaacaagttgatactacggaattgaaaacaggcgaagtaggttgggtggtttgtgcgattaaagatattttaggcgcacctgttggggatactttaacccatcatcacaatcctgcaagcgaagtgctaccaggctttaaaaaagtaaaaccgcaagtttatgcaggtttattcccgattagctcagatgattatgaagcgtttcgtgatgcattggcaaaattgagcttaaatgatgcgtcgcttttctatgagccagaaaactcaacggcattaggctttggcttccgctgtggcttcttaggcttgttgcatatggagatcattcaagagcgtttagaacgtgagtatgatttggatctcattaccacagcaccgacggtagtctatgaagtggaacaaacgaatggcgaaattgtctatgtagatagcccgtcgaagttgcctgcgattaacaatattgcggaaattcgtgagccgattgcagaatgtaatatgcttgtaccacaagagtttttaggtaatgtgattaccttatgtgtggagaagcgtggtgtacagacgaatatggtttaccacggtaaccaaatcgcattgacttatgaaatcccgatgggtgaagtggtgttagatttcttcgaccgcttaaaatcgacttcgcgtggttatgcgtcgttggattatggtttcaaacgtttccaagcggcagatatggtgcgtgtagatattatgatcaacggcgagcgtgtcgatgcgttagcgttaatcgtccacaaagccaatgccccttatcgtggtcgtgagttagtggaaaaaatgaaagagttaattccacgtcagcagtttgatattgcgatccaagcggcgattggtaaccatattatcgctcgttcgacggtgaagcagttgcgtaaaaacgtattggcgaaatgttacggtggtgacgtaagccgtaagaaaaaactgttgcagaagcagaaagaaggtaaaaaacgtatgaaatctttaggtaacgtggaagtgccacaagaagcgttcttagcgattttgcacgttgggaaggattagtgaatagatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggacacactgagtgtgtccgcatacaacattcatatctattctattgataaatgttgcaatggacacactcagtgtgtccctacattttggatagtaaataaattccaaaaggagtcaattttaaatatgagcaatattttaaccattggttttattgcagtattgtacggtatttggaaagtgttggactcaatgcaattgccaaacacgatttccattatattagtaggtttagttgttatttgtggtggcttttggtcattttacaaatttagtgccgaacctcgccgcttgcgtgcgattgagcgtgaagaaaagcgtttaggcaaaccgctcaccgcagaagaaaaagcagcaattcaaccacgttccttagtgggtgatttttttgcttcactatttggggtgttagcattagtcactattttacgttcatttatttttgagccgtttcaaattccaagcggttcaatggagccaacattacgcgtgggtgattttctgttagtgaataagtttacttacggaattaaagacccgatttggcaaaatacccttgttccgatgggtaagcctgaacgtggggatattgtggtatttaaagcaccaaaacagccacacgttgattatattaagcgtgttgtgggtgtcggtggcgaccatgtgaaatatgattttcatacccgtaatttaaccgttgttcacggcgattcgggtaaagaagtggtgtttaaatacgaaggcggtacaccaaatcctgactttttctaccacggtgaaatgcaagttgaacgtaccgaaattggtgatgttactcaccagattttaaataatccacacgcctttaactatgagccttatttcttcaaacaagacggtattcctgctggggaatgggtagtgccagaagggcattattttgtaatgggagataaccgtgataacagcgaagacagccgtttctggggatttgtgcctgaaaagaatatggtcggtaaagcaagtgtgatttggttgagccttgataagaaaccgaatgaatttccaagcggattacgttttgagagaatgtttacggcgattaaataaagagaacatttccccctttgaaaaagggggattaagggggatttttaaagcgtgaattttattcaatgttagcaaaatcccccctagccccccttttcaaaggggggaattctatgaagataaactaaaatgcaattagaactattacagaaaaaattaggttatcaatttgctaaccttgattacctcacccaagccctcactcaccgtagtgctgcttccaaaaataatgaacgccttgagtttcttggcgattccatcttaaattttgccattggtaaagccctatatgaaaaattcccaaaagcgaatgaaggggaattaagccgtatgcgtgcggcattggtgaaagaacagacccttgcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgtcagtttgagttaggcgaatatatgaaattaggggctggagaattaaaaagtggtggctatcgccgagagtctattttatccgattgtgtggaagcgattattgccgcggtatatttagatgctgggattgatcgggcgatggaacgtgtgcattgttggtatcagcaacttctaaatgacatgcaactaggggaagcacaaaaagatccgaaaactcgtctgcaagagtatctacaagggcgtaagctacccttaccaacttacgaagtgattgatattaaaggcgaagcccataatcaaacttttaaagtcagttgtaaagtcgaaaaagttgatgaaatctttatcggtaacggcacaagccgtcgcaaagccgagcaagatgcggcattgcaggtgataaaggtgttgggaataaaatagcctaatgcagggtggctcttgacccaccatttcaatttgtatttatttaagagaacacaatgacagatcaaaaaacatattgcggctttattgccattgttggtcgcccaaacgtagggaaatcaacgctattaaacaaaattttaggacagaaaatttcgattacatctcgcaaagctcagacgacacgccaccgcattttagggattaaaaccgaaggggcgtatcaagagatttatgttgatactccagggcttcacattgaagaaaaacgagcgattaaccgcttgatgaaccgtgcggcagccagtgcgattggcgatgtcgatatggtaatttttgtggtagaaggcacgaagtggaccgacgatgatgagatggtactcaataaattgcgttcgaccaaagcccctgtgattttagcgattaacaaagtggataatatcaaggaaaaagaagaattattgccacatctgaccgctttatcgcagaaattcccgtttaaagagatcattccgatttcagctcaacggggcaaaaacgtacatattttagagaaatttgtgcgagagtcactcaaagaaggcattcatcactatcctgaagattatgtcaccgaccgttcgcaacgttttatggcgtcagaaattatccgtgaaaaattaatgcgttttatgggtgaagagttgccttattcggtgacggttgaaattgagcaatttaaaaccaacgaacgtggcacttatgaaatcaatggtttgattttagtggaacgtgaagggcagaaaaaaatggtgatcggcaacaaaggtcagaagatcaaagtgatcggcactgaagctcgtgcggatatggaacgtctgtttgataataaagttcaccttgaactgtgggtgaaagtcaaagccggctgggctgacgatgaacgtgcgttaagaagtttgggctatattgacgaataatgatcgaacagtggcaacgtggctttgtgctacatcgcagagagtacagtgaaagcagtttgctcgttgatttttttactgaaaatcacgggcgaattaccttacttgccaaaggggcaagacgaccacgttcgccattgaaatccattctccagccctttacccctttactgctgaaatggacgagcaaaggcgatctcaaaacacttaccaaagctgaacctgcatctttaaccctcccgatgcaaacgctggcactgtatagcggtttttatgtcaatgaagtccttgcaagagttttggaaaatcacaccgcttaccctgaattatttcagcattatctacactgtatgacaaagttggcaagccagccaaacgagatcgagccgatcttacgcacctttgaatttcaaacacttaaagcgttaggttatggggtggatttttgccattgtgcagcaacaggtaagcctgtcgatccaaaaatgagctatcaatttagagaaaatgaaggctttattgcctctttattacaaaataactatacctttatcggcaaggatttattagcttttgcggaaatggatttttcagagaaagaaaccttacaatcggcaaaacgtttcacccgtattgctttaaagccttatttgggatcagcacagctgaaaagcagagagctgtttcagtctgttttaccaaacagattaaaagggtaggtcggacatttatgcccgacctacttggagattcctttcttaatcatctcttcaaaaaacggataatccactaaaaatgcatcgtgtccaaagtcggaatgaaattcataaaaatcgacggcaatgcctgcattttctaaacgttgtttgcttttgtgtaggtcaatctgtttaaacagttgatcgctcgttacgccgacaagggtgtaattcgctttaatgcgactgagtgcttcttgctcgtttgcataggttaaagcaggatcatagagatctaaggctcttaacaggcgtaagtaactattagcgtcaaagcgatctagaaatttgagcccttgataacttaaataagattctacttggaagtgatcaccccaaatcgttcccgtctgtttcacttctctcccaaaggctttggcaagttgtacatcggtgcggtaggtgagcataccgagcattcgggcaatttttaagccgttatctgggggcgtactgccataataatcgccgttgttaaaatggggatcgtttattaccgcttgtcgcataacgtgattgaagccgattgcttctgaactcaaggtaagcgaagaacagagattgactacatttttcacttgttccggataatcaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccactgtgtcgcttgcattccaccaaaagagccacccacgaccgcttgtagccgagtaataccgagtttatcgatcaaggctttttgcaccttcacaatatcttgcacggtgataacgggaaattgactgccgtagggtttattcgtatttggattgatagacgaagggcctgtcgtacctttgcaaccgccaagcacattcgagcagataaaaaagtatttatcggtatcaaaagctaatcctgcaccgataaaatcttgccaccagcctttatccgcaggcggtgcataatagggttcagcatcgcctgttaaggcgtggcacaacagcacagcattgcttttttcagcgttcaatgtgccataggtttggtaagcgacattgataggcgaaagtgttccgcctaaagcaagctcaaggggaatatcatcaaaaagagtaatctgctgtgccataaaaatccttgcaaaaaacggtaaaaaagcgaccgcttgtctttgaatggtttcaagtttacgaataggaaatcgtttcgtcaagaaattttagacatctaaacgtctagatttttaaatggctaaattaattattgtattactatgggcacttatgctgtcagaaaatcattttgggatatagaattactcatccttaggaataaccacagcaggatccactttcccttcaaaaccatcaatcaatttttttagcccataatcttccttgtctgaatgaggactaaataaatcgacttctgtattcaatttcggattactaattcccacccattttgcaatgccatcggtaaagtttaagccagatttcatcgctttatagacttttctatcggtatcatcactagatattttaaagagcggaacatcaaagtgtagcttacttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaagtgtagcttacttttgccactgctgttgtggattgcaatgtcattttcagtgatatggtgagctaaaccgtgatcggcaaaatagaccaccgaaaacgagcggttagattgttgctcatttttgcgaagggtttcatataagcgttttaacacttcgtcggtttttttgatggacgatgcatagcagtttacgttgaaatactttttgcctattttttcatcatcaaacattttagggtaatcagttaaacgatcacagctgatggggtgtgaaccgtataaatgcaccacaacaaaacgtttgctatgagttttttgctcaataatgtgttcaaatttaggcaataaatcaaagtcactgatattttgatggaaagagtcccacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccacgattttaagaataatttttcgtcacttttgttagcaagggaggaaacaggtgtatcaaaagtaccaagataaccttagtttgatagccagtaggttttaattcctgcggatttaatcaaatcgatcataccaaggctgtattccccttcccacttttcagtatcaggcttagtgagcattaattttaatgaagcaatggtatttgttccaccagcggtcagcccatcaattaaaatgccgttggcactgctcataaacggcgtattttcagcagggtagccataggcgtggtgataatcttttctagcactttcgccgatcactaaaatgtaatcatcgtaacggctttccgcattgagttgcgacgttccccattcactttgaatggacatactattcaagcggtctaattctgcttttactttactaattgcactacttccttcttgtagaaatttgaagggcggagtagagataaaaactaatgcaatccctaaggcaagaaaggttttatttttgtggaactgaatttgccatttttggctaataaaacgaaaacctaacagtgatataaaaatgccagtacaagcaacaaagttaatcagggggatttggctgaaaaactctttgctttcttgtatatctgtggcaaaaaccgaagcaaggtattggtacgatggtgggccaaaggtcaagccaactggcgtgtaaagggcatataaagtgacaatcggcaaaagcagataaaagaacgcttttttagaggcattagcaaataaaataacgagaaccagcagtagcacattgctgatttcaggagtaggaaaaaagcctgagccaagtaacattaggtaacttgctaaataagataaaccaaaactaatgagagtagcgagtatctttgttatattcattatgagcaaaacgaaaataaagggatagcgattttaccgaaaataaagtggaaattctatccgcttgcctactttgatctgttcttaagataatctataatatttcgatttttttccccaaccgttacacagaggtcaaaatgagcaatcctatttataaacgtattttgttaaagttaagtggtgaagcattacaaggtgaagaaggttttggtattgacccatctatcttagatagaatggcattagagatcaaagaattgcttgcaatgggtgtcgaagtcggcgtagttcttgggggcggtaacttattccgtggtgctaaacttgctaaagcgggtatgaaccgtgttgtcggcgaccatatgggtatgcttgcaaccgtaatgaacggtttagcaatgcgtgatgccttacaccgtgctgatgtcaatgcaaaattaatgtctgcattccagttaaacggtatttgtgatacttacaactggtctgaagccattaaaatgttacgcgaaaaacgtgtcgtgattttctcagcaggtacaggtagcccgttctttactacagactctgcagcttgcttgcgtggtattgaaattgaagctgatgttgtattaaaagcaaccaaagtcgatggcgtgtatgattgcgatcctgcgaaaaatccagatgcaaaactttatcaacatttaagctatgctgaagtgattgaaaaagaattgcaagtgatggacttagccgcatttactcttgcccgtgaccataatatgccaattcgtgtatttaatatgggtaaagccggtgcgttgaaacaagttgtgacgggtacaacggaaggtacgacgattgcttaattaacgctattcaacgaattaatccaacttaactatttatttaagttggattttttattctttactttgccatttcaaattcaattaacatcatgagaatatggattactttaatatgtatctcttgaatacgatcagcataacgaaaatgaggtacacgaatctcaatatcagctagttctgctatttttcctccatccttgcctgtcattgcaataattttcattcctttggcttttgcagctatgattgcattaataacatttttagaatttcctgatgttgataagcaaaacaagatatctcctttttgtccgattgcctcaacataacgagaaaagacatattcatatccaaagtcattgcttacgcagcttaaatggcttggatctgagattgctatggctggatatccaggcctattttcacgataacgtccagttaactcttcagcaaaatgcatagcatcacagtgtgagccaccattcccacaggaaagtatttttcccccgttcttaaaactatcagtaatcagtaaagctgcttcttgaattagtttaagattatgttggtcattaataaagtcatttaatacttgttgcgcttcttgtaattctattaaaatttgttgttggtacataaggattccctcttgtgatgagttaagtcaaataagtctaccacaaaccctataaacttagtactaggaaaatagaatgaaattgggtaaaatcaataggtttatgttattcaatcaaaggaaaatactatgattaatgaaattaagaaagatactcaagaacgaatggaaaaaagccttgaggccttaaaaggacatatttctaaaatccgtacaggtagagctcagcctagtttattagatgctattcaagtggaatattacgggtccgcaacaccattacgtcaattagctaatgttgtcgcagaagatgctcgtacattagcagtcactgtatttgatcgttcgttgattagtgcggtagaaaaggcgattttaacttcggatttagggttaaatccttcttcggctggaactactattcgtgttcctcttcctccattaacggaagaacgtcgtcgagatttaattaaaattgtaaaaggtgagggagaacaaggtaaagtttcaattagaaatattcgccgtgatgcaaatgataaaattaaaactttagagaaagaaaaacagattagtgagaatgatgagcgtaaagctcaagatgatatccaaaagattacagatatttatatcaaaaaagtggatgagattttagcagacaaagagaaagaattaatggatttttaacatatgaattgggcggaaattttccgctcaatttattctaactggtagaagagatttaagatgttgttatgaatttctttattggtttccaatgtctacatcctatataaatagagtaaaaccgtttcattttaagagaaaaaatgatagaaaaaacctttattgtggggaaagatgcagcccttgaagaaagcatcgaaagattccagactaagttgaaagaattaggatttaatattgaggaggcttcttggcttaatcctgtaccaaatgtatggtcagtacatattcgtgatgttgattgtccacaatgtttttcaaatggtaaaggagcaagtaagaaagcagctcttgcttccgcattgggggagtattttgagcgtttatcgactaattatttttgggctgatttttatttaggaagggaaattgctgaaggtgaatttgttcactatccaaatgaaaaatggtttcctattgaaaatgaaacggaattacctgaaggaatattggatccatttctacacgactattttaatccaaatggagaattgacaccagaatttctggtagatctacagtctagcaattcagaacgaggaatagttgcattaccttatattcgtcagtctgatggtcatacggtatatattccacaaagcattattggaaatttatttgtatctaacgggatgtcagctggcaatactaagaatgaagccagagtgcagggactatcggaagtatttgaacgctttatcaaaaatcgtattatcactgaagcaatcagcttgcctgaaattccgcagtgtattattgatggttatccgacgattaaacgttcgattgagcaattggagcaagaagggtttccgatcctctgctatgatgcttcattaggtggcgaatttccagttatctgtgtagttttacttaatcctaggaatggtacgtgttttgcttcttttggtgctcatcctaatttccaagtcgcatttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaatgcaggggcagtagcataacctggaactaaaaatgcgagtggttggaagaaaagcattaataagaacaacacgccaacaacgaccgcagtcaaacctgttttaccaccaacagctgttcctgctgctgattcaatatatactgctgcaggcgcggtaccaaataaacctgaaagtacgctacttaatgaatctgaagtaagtgctttatcaccgttgataatttgcccatctttatctaataaatttgcttgacctgctacagcacgaatggtacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgcgtcaaaaatggcagtcattactaaggcaaagaccacaggtaaaatggctgcattcaatgcgccgacaatatctaaatttaagaattgagaattttcaccaaaggtcggtaatttgaatacttcaccgccaaattttacattcggatcgaaaattaaaccgatgattgtaattgcaatgataacccaaagaatagaacctttaatttgtaaacgctctaaaccaatgatagcagctaaaccaattaaagacatcattacaggaaaagaagtgaactcacccatttttaccggtaaacccgcttggttgctgacaactaaaccaacgccacttgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcaatcaataaaaggaataagccgattccaattccagcgccgtgagcaatactagatggcagattacgcaaaatccacgcacggatacctgttacagaaacaatggtaaataaaacacccataaggaagattgcacctaatgcaacaggaatactaatgccttgacctagcactaaactgaatgcagtaaaagctgttaatgagatagcacaaccaatcgccattggagcatttgcccataagccaatgaggattgaacctaaaccagcaaccaaacaggttgcaataaatactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatagtatgattaaagggtcgaggattctacacaaagataaaccaaaaagcaatcgtttgcgctgccagtgttgaaaatatttaggttgagtgctataagaaacatataggttatctaatgtatttaaagtgcaaaaataagaacattagcgtttattaatatctcctaataagcctgcataatggatcgttttagggctcgattctaatgcaattttgagagccattgtcaatggaacagaaagtagcattcctactgtaccgagtaaccatccccagaaaagtagtgacaagaatacaatgagagttgagagaccaagggttctccccatcattctaggttccagaatattgctaattaccatattgattgcaatgataccgacggatactcccaatccaacagaaaaaccattcaatagaaatgcttgtacagcaataggtacaccagcaatgattgaacctatgtttggaatatagttgagtaggaagcttaatgtgccccataatacagcatattgtacatcagctatttcaagtaacacccaaatagatatccctgtaagcaggcttacaatcgtttttatgccaagatagctaataactccctgtaatactcggttgatatggctttcttccgattccacatctttattgcctctaagagccacgataagtttatgtttagcggttggggcctcaaataacatgaacacaacgactaataagagtacaaaaatatttgtaacaacgcctgagaagctaagtaataagcgactaacaaagttcataataatgcttgggtctagctgttcttggatctgttcacgagatattgaaaccgggatattccagttatcaacaaggagcattgcggcagcaatacgttcagatagaagaattttgtattgtggaattgatgctgtaaattcttgtactgtactgttgattagtcctgccagaaaaaagaatccaagtaaaaataaaataaagagtatagtgattgccagccacaaagggactttatgagaggttagatatttgataataggagaacaaataattgcaataaaaagagataataagaaaggaataacgatctcaacggataatttaatacccgccaaaataattacaagagcagcagtagctaccagaatctgagttaaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagttaaagaagaattttgttccatatctacgagaatatattgctatgtgattgagtgatggtatatcaaatgtttgtatttttagatcctactatgttaatagctagtgattacttctttcaacaactccaccgccaagaacgctaagctaaaacgctgttcatcagccactgtccagaattgtagtgcgttttcatttttattgagtagttggctaatctgtaagagatttacctcttcatcttcaccatttttaacaggggtaaccacattgtcagagttaaattttacccacgcttgttgttgccactgctcacttaatgcggtggcatctaaagcatactcagattgcacgctgatcatctgtgaaatgccatagaaaacaggcacttgcacggaatggaaagtcacactagcggttagatttggcagaacttttgcaagttgtaactcgaaggcacgagagaacggcaggtgtttttcatcaccttgcacatttgcaggcacggcatcaaacgccacacgtggtttttcatcatcaaggggaataccgtttaacaactgggcggtttgtcctgctaactcacgcactttttcatcaccaaaatacgccgatggcaacagtgatgtgacaaaaatatgttgaataggctgatccaacaatggctttaaggcgagtgctaattggctgatttgtggatttgctaaagcaacaatatttcgctcacgcatattagcgatcatttcgttgtttacacttggcacaatcacaggcacattgccgattaatgcagaaatgccgtaaagatctaaaatcacacagcctgcttgtaccgcttgagccagcaattctgcatttgccattttgcctgcaaagagaacgtgactaaattgcgaccaatcgacatcttcaacagcgatttgctcaacagcttttgcaccgaaacgcagagaatgttcttcaccaaaactttccaattcaatggctgaaatttgttcaaaatctaaactactttgctctaaggcttctaataatttctcggctaataaaaaatctgctgcaattgctaaacgaatgtttgccattttgtttctctctcgtcaaaataaagactaattttactcttttttatcgcgattgcgaaaggaaaaatagacctcagatattgatttttgaatctcattatatgtcgtgaatctttgatatgtatcattatgaaatttatcattatttcaaccacttatcttcatcttgcttacgctcaaactccgcttcaaaagtcgtattattttgagaggaagtcctgttcattgaaccaaaggacataaatttcacacggcttgcaaagagtttcataaaaattgcctgtagcaattggcgagtgattggcaaaagaagtagcaaagcgacaatatcacttagaaaacctggaataatcaacaatacccctgcgattgcaaaaaagatcgaagaggtgaccgcttgtgccggaatctttccttgtgcgatctcttggcggatctgcattatggtcattattcctcttaatttcactaaccacaaaccgaccgcagaaatagtgatcattaataaaatcaagggtaaaaccccaatagcagagccgacgcttactaacagagagatttcaatgtagatgtataaaaatagcccagctaaaaagagaagtaatggcatagaaatttccttatagaagttaatcgccgattagatagtgataatttgaacattttcaaccctagccccccacaactcaagtaaatttaatctatttaaagctaatcgtttgcttttttcatctagagataaaaaattcatttgttttatgcaaaaaatatgctatttatatagccattcagcttttattgataaatgaaaatgacattacgttctcttgttagcctgattattattaacctcgtggtgattattatcaccgcgggggttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcaccgcgggggttaagttggctcgcaattagaattgtataatgagatccacaaaccctcgctagttttagtgagggtttttttattgtataaaagccttaactaaatagcgacacaacattaaaaggtaatttatgaacggtgcaaatttggtcgttgagtgtttgaaagctcacggcgtcacttctctttttggctatccaggtggggcaattatgcctgtctatgatgcgatttacgattcaggtttagatcatctactttgccgcaacgagcaaggtgctgcaatggctgctatcggttatgctcgagcaacaggcaaaacaggcgtttgtattgcaacttcaggccccggtgcaaccaacctagtcacaggcttaggcgatgcattaatggactctattcctatcgtggcaatcacagggcaagtggcttcagcctttatcggcacggacgctttccaagaagcagatgtattaggcttatcccttgcttgtaccaaacacagtttcatcgtgcaaaacattgatgaactacctgaaattatcgccaaagcattccaaattgcacaaagtggtcgccctggtcctgtgcttgttgatattcctaaagatgtgcaattcgccccgacatcactttcccctatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcccctatcgtctatgaaaaagtggcggctaaggcacaaaatccaaccgcacttacacaagccaaagccctgttagctcaggcaaaacgccctgtactttatgtcggaggtggtgtaggtatggcaggtggagtgcaagcggtcagatctttcctagaaattgccaatgtgccctctgtttccacattaaaaggtttaggcacaattccgccacaacacccactctatatgggaatgatcggtatgcacggcacaaaagcagcgaactatgcggtacaagaatgtgatttactcatcgcttgtggggcaagatttgacgaccgtgtaacaggcaaacttgataccttcgcaccgcacgctaaagttattcatattgatattgatgtggctgaaatcaacaagctacgcaaagcagatgtggcattgcagggagatttaatcgaggcagtgaccgcacttactcaaccgctagagatcgaaaactggcgagctgatgtgcgtaaaatgaaagcagattttgattttacttatcaagaaaatgcaggcgaaggcgaaatcgacccttgggcattgttacacaccctgtcgcaacgcaaacctcaaaatgcgattattactactgacgttggccagcaccaaatgtggtcagcacagcatatgcagcattatgcccctgaaaactacatcacttctgctgggttcggcacaatgggatttggtctgccagcagcggcgggtgcggtcaaagctcgcccaacggatccaaccattgtgattacgggagatggctcttttatgatgaatattcaagaactcggctcaatcaaacgtggcaatttacctgtcaaaattctgttactcgacaaccaacgtttaggaatggttcgtcaatggcaatcgctctttttccatggtcgccacagtcaaaccattttagatgacaacccagactttgtgatgctagctaacgcctttgacattccagcagaacgcattgaaaaagcaggggaagtttcagccgcattagaccgcttactcaacagcaaaggagcgtatttattgcacgtttgtatcccagatgaagaaaatgtgtggccactcgttccaccaaatgcgtgcaatacagatatgttagatgaagacattggggtttaaggagaagaaaaatgcaacaatatcaattcgttatcaaagctaataaacgccctgaaacccttgagcgtttactcagagtgatccgccaccgtgggtttgaagtgctatcactcaatgcagaaaataatggttcgggaattacgttaaatgtcaccgttcagagtgaaagagtggtggaattattgtttaatcagttggtgaaattgccagatgtggtgactnnnnnnnnnnnnnnnnnaggagaaaactatacaaatcttaaaacgctttttctgttactgcttgattttatgttttatgacagcttgtactaaaacagagtatcaagatgaaaataccaaaacagaaacaatccgagcattttttattgctgataataaattatatgttgtcggagatttgcatagttatcaatttgaaagcagtaacaaggagaatgctgattatcaagagcggaaaaccaccgaatttatccgtttgcttcaatctgaaaaaatgaaatctgttactaaagcagagattatttatatcaaaaatcaaatgaaaacacctgatattgagtctagggtaaaactcacttctttacataataagaaatcatcagaacagttttatgacatttatgggaagttggtcaaaattgaaaatcaagatgcagttctgaacaaagccaaattagaacagccactacaaacacaatttatagcatattcagaaaaaataactttagatagtgaagctactggaatggttcttgtttggggtataggaagcgtggttttcattcctctttacattatcttttcaccgcttgtattgataaataaaatatcggattaatgtgatggaaggggagaaattcgataaataatccatacaacaagcggtctgattcggcaaaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaagaatatagcaatgattaagcaaaaagtccccgtgggcgttccacgggggtatgaatgtgctttcaagtagttgtttatcggattacaattagaaattgtacttcgcaccaatatttccttctttgtaataggatttcattggattattccataatctataataagcgatgttagcataaatattgaagttttcagtaagataataccccatacctaaactagttttaaattcatattttggcaatctcattccatataattttgtttcagtactagaaacaatatattttccacttaacatattattcatactgttcttattataaagataagaaacatctagatttatattaagtttttcagataatgattgatttaatcttaagcccaattcatatccataatgggttttatgatatttatcaatacttaatgctaaatcttctttttcattgatggaatcttgttttaagcggttaatatgtaaagcaatatatggattaaatcttaatttttcatattgtagatttagtcctgtttcattataaaacgaataatttcgtaattttaaatcagctttaattgcctgcgttccattaggcaataacaatgttctatctaattttcctttaatatcagtaaaactgatttggctgagataataccatttattccaatcatattttccgtataaggcgaaactgtgttgttttaaatctacttttccaacttgttgatctttattagataaaggagataatttttgatgaactcgttgcaatcccataccaaatgtaaaggcattaaattgcttatctataccaactaattgtgaatctgcactattttttaaatctgcaaatccaaaattatcattctgataaagttttaaactttgtgtagctaactgagtataaatatgataagacttaatatcttgaatatttgagaattgctgtttagcaatttgtctattcaaggttttaatactattcagtgctacctgatgtaccgccggatatatttcgccacttaaagaatccactgcagaagctaccgcttgtggtttagcattaataaaggataatgccgtacttctgaggtttctatttgtgtttcctgaatcactcgcactatctaaaataagatctaaacttctcgcagtatagacattctttaatgaactttcattagctgcatttaatacaaattctgtatcatttcgtttataggttgcaataatttctttattattcccttcttttaatttaatttcttttaaatcaatataagggttagcctgatctgatattttataattttcattataattttnnnnnnnnnnnnnngactcaataatagttttagtttgaggctctctttgaaccacttcattaatattttcaacatcggctacaatataagaaccttgtaaattaactgttccatttacttttaatttagatttatctatatcaataaccgttctggcattatttgaagtagtataattaccctcaataattaacccctttccataaacctccaaggaacctttattatctacattttttactattttaacttctgtttgagagttatttaaatttttcgttaataatgttccctgtgactggatttctactgtggattgttttaattcatttccaattaccaaagttccgttttcgataactgtatttccactataagaatttgaaccagtaaaataaagtgttccagtaccttgttttttaaagccagcatcaccttgaatattattggaccaagtgtatttagtgcggtcggtatgatgtttataatctaattttgctacaacatgggttttattatcattggttaaaagttttgtatcaaatctagctggtccgtttaatgctctatcttgatttaaaacaccccaaccaacacgttcgttaggttcttcggtnnnnnnnnnnnnnnnnaatttatttgcggtggataatatagtttgggtcactaaatgatgatccatccaatcaaatttttcccaaacattagccacggcagcagtaacaacaggtgtagcaaaagaggttccctctgttcgtactttatcaccaaataagtaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccactattttgtgggtttattgaagttacaacaatccagccttttcttgctccatctcgtattacaggcacatgcccctctatggttgcatattcattctgtccagtttttttatctctgccatcattacctgatgcccatacaaaaatactgtctctttctgccatttcagctaattgtttatannnnnnnnnnnnnnnnnnnnnttcccacccttttccatttacactgtctctatgtggattattaccataagagttgttaaannnnnnnnnnnnnnnnnngtatgcttcatcataatgctgattagatgcacttacagcttccatataagcggattttgcagtataagcataaagcgtagcatttttgtttttctgatcgataacaccagcaaccatcgtaccatgagagcttttatgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccattttcaaatttaaaggcatttccaagatcatcacgcacattataatccatatccacaatcccaattttattagtgaattttgtttcttgnnnnnnnnnnnnntaattatttttatctaatttctcaacttcaggtttagcccaaggctgattatccacaggatttattgatgaattagattgcgtagaaggattattttctggagttgtagattctgaattattatttaaatttaaagtaacatcattattttctaccgaattatttccagatacattattttccgtatcagtatttttattatcatcactatttccagcagataaattattattttctnnnnnnnnnnnnnnnnnnnnnnnnnnnnnnnnnnnnnnnnnnnnnnnnnnnnnnnnnnnnnnnnnnnnattattttcttgatttatattttctccagaaacattatcattatgaacaacattatttgccggatcagtattgttcgatatttcattatttgtcgcttcgctatttgtcggctcattatttgttgatatttcattgctgttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcctctgctggtaaattttcttccgcctgtggattttcctcttctctaggcggttgtttttcagtttctgtttgtggttgttcttgatgttctacttttggctcttctgtgatttcytcttttctttcctcttttgctacttcttgcttatctgtcgtttctgctgtagcttgttcattgttagtattttccgtactaggtttatctgtagcatttggactgtccgaagttgtttgatnnnncgaagttgtttgattatccgaaatggttggttcatttgaagttgttgaactatcagcagaacttgagctatctaccttaggctcatcagatggtttttgactatcagaagtnnnnnnnnnnnnnnnnnnnnnnnnnnnnnnnnnnnnnnnnnnnnnnnnnnnnnnnnnnnnnnnnnnnnnnnnnnnnnnnnnagaatcgctagagctatttaaacgttgattagtgttggaagaatgagaggtaagtgcattatgattgtctgtctgtctgtctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtctgtctgtctgtctgtctgtctgtcagggagtttattaaatccattatttgtagttccactactttcagcactagaatggctacctatcgacgaattaactggattttgttctttattatgttggggagaatttccgccagtgccatctttcttacaagaggatatcaacacagcagaagataaaagcatagtggataatattgattttttgatgttcataatttgtaccacttatttaaaaaatttattttatgaaacttgggtggagtaatttctcgctttaatactctttataaagatcgtaattaatttttatgtaggcgagcattagcggataacgaagattactttgcaccagcccttatnnnnnntattttatctgaaaaattaatttttcaaaagataatgtgctattagttatttataacttttagaaataagagaaacgccagaaacagcgttgaaaaatccctctctctccaaatcttaactacacaatcccccccttttccgctacaatccctataattttttgctatattttagagagatttagaatgtcaaatccaaaaagaaaaatactggttacttgtgctttgccttatgctaacggtgcgatccatttagggcatatgcttgaacatattcaagcggatatttgggtgcgttttcagcgtatgcgtggcaacgaaattcactttgtctgtgctgatgacgctcacggcacgccgattatgttgaatgcggataaactcggcattacccctgaacagttaatcgaaaaagccaaagctgatcacattgctgattttgctggctttaatatcagtttcgataactatcattccacccacagcgaagaaaaccgtgaatacacttctgccatctataaaaaattaaaagcgaatggttttatcaaaagcaaggtgatctcgcagttgttcgatcctgaaaaaaatatgttcttgcctgatcgctttgtgaaaggtacttgtccgaaatgtaaagcggaagatcagtacggcgataactgtgaagtctgtgcttctacttatagcccgatggatttaatcaatccacgttcggtagtgtcaggctctacccctgtggtaaaacagtcggaacactttttctttgacctaccaagctttgaagaaatgctgaaagcgtggacacgctctggctcgcttcaacctgaaattgccaataaaatgcaagagtggtttgagagcggtttacagcaatgggacatcagccgtgatgcaccttactttggctttgaaattccagatagcgaaaacaaattcttctatgtttggcttgatgcccctatcggctatatggcttcgtttaaaaatctttgcgaccgcacgggcttgaactttgatgatttctggaaaaaagagagtgatgctgagttatatcattttatcggtaaagacattgtttacttccacagtctattctggcctgcgatgttagaaggaagcgaataccgcaaaccaacgaacgtttttgctcacggttatgtgacagtggacggacaaaaaatgtcaaaatcccgtggtactttcattcaagccagcacttatttaaaacatatcgatcctgaatgtttgcgttattactatgcggcgaaattgaatgatcgcattgaagatcttgatttcaatttagaagattttgtacaacgagtaaacagcgacatcgtcaataagttagttaatttagcttctcgtaccgcaggtttcatcacaaaacgctttgaaggtaaactggcttcaacactagaaaatcaagcgctttttgatgaatttgttgcacaatcggagcatatcgccacttattttgaaacgcgtgaatacaacaaagcgatccgtgaaattatggcattaacggataaagccaataaatacattgacgacaaagccccttgggtaattgccaaagaagaaggcaaagatgccgaattacaagcggtctgttcaatgggcttagagctattccgtgtattaatgagctatctcaaaccagtattaccaaaactcgcagaacgtgccgaagcctttttacaaacggaactgcgttgggacaacatcggttcaccactatttgcccatagcattgcaccgtttaaatcgctcttctctcgcttagagaaaaaacagattgacgctgtgattgaagaaaccaaagcacttttcgccgaaagcgtaaaagcagaaactgcaaaaaaaggaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagaaatgaccgcttgtgaaaccaaagttgaaccaattgcctcagaaatcaccattgacgacttcgctaaactcgatctgcgtgtggcaaaagtattgaaatgtgaagctgtgccgaaatcagataaattattacgttttgaactcgatttaggcgaccatactcgccaagtcttctctggtatcaaagcggcgtacagccaacctgaagagattgaaggcagatttgtgattatgattgccaaccttgccccacgcaaaatgtcgtttggtatgtcggaaggaatgattttatctgctggcacaggcggtgcagatctctacttgctctctgccgatagcggtgtgacagctggtatgcaggtgaaataaatttactcagggtgggatttctcaccttgtcttaactcaataataaggacaacaaatgatccaacaaactctcgccattattaaacccgatgcgactaaacgtcatcttatcggtgaaattttaagttatatggaaaaaaatggcttagcgatcaaagcgttaaaaatgcttcacttaaccaaagaacaagcggaaggtttttatgcagaacatcaaggcaaagatttttttgatccgctcgtagcatttatgatttctgagcctatcgttgttgcggtgttagaaggcgaaaatgccgtagaaaactaccgcttgttgatgggagcaaccaaacctgaagaacgcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctgacattcctgcaatcattttggggcaaatgtaatttgctcttacaaccttatttataggggctgatgtaggttggtatactagctaatctaatacagccccaaaagttttgttaaaaagaagcactggttgggaagcttatgtgcatttagccaaattggggcttgggtttcttcttcggggtacttttttattggggctaatctacgtcagcccctaaagttttatggtaaaaggcttcaaattaccttttaaaatatgaataaaatgatctgaccttcaaaagttatacagctattcaaaggactgatttcgatattgtatcggacttagtccttttcgtttggggttttgtttttctgcgaagtaggtactgtgattgatgcgaaaatgattaaactcagttacatcagacttatcatagtttcggtagaaatcggtgtaaacaatactgccgggcttcacttgttcttgaatatcgaacctcttaagatgtagactgttttgcttgataagcaatcacagacgatggaaataataggctgcggtagctttatttacatttatcaactcagcagctgttcgagcagtgatatctgctacaaacagctcaataagtttattttgtttatactgacttagataacttttgctcatagggctatcttaacctaatagggattttagtcgttatctaggagagacctataaatttactaggaggaagtttctcaccctgccttaacttgaatataaggataaccaatgatctaaaaaactctcgccattattaaacccgaagtgtctagctccattctattaatgtaagcgacttacaccttcggcaaaaacaatctcaacaccaacagtgcgtacattacttttgctaaagcaaaggtcagggcgaataagatcacggcaagggattgttcccataggggaataggatcttcaaggctggtgtattcatcaaaagctaacatcaatgaaaatgaaaaaaggctgtaaatgaacattattacccctgagaaaaaggcaatttgaatgatgttacgttggtgatattgctgtttgtagctgactaatgcaaatagaaaagctgggacggtaaataaagcaaaaacaaccaacattcccccttggctaaattcgctaaaaagaggtaatagggcagagccgagtatctgggtaagtagtggataaatccataaaatatgtaggctagtttttggcattgagatattctcttaataaaaataaggcggataaattgcgtgcttcggcaaaattagggtcggcaagcagttcgtcaattttgtttaatggataatagatgatttcaagtggctctggttcatcgccttctagctgtgatggatagagatcttgagccacgaaaaggtgcattaagccgtacatatggctaggaccgctatacactgaacgcagtggttcgattgtttttgctccaaaacctatttcttcttgtaattctcgatttgcactcagtacaggatcttctccactatctacaatgcctttagggaaggtgagttcataacgttcagggccgacagcatactctttnnnnnnnnnnnnnnnnnnnnnnnnnnnnnnnnnnnnnnnnnnnnnnnnnnnnnnnnnnnnnnnnnnncgttcataggtgcgttcttcgccgttggaaaaacgtaaatcgacggattgcacttcaaaaatgcgagttttggcaattactgagatagatttgatttcaggnnnnnnnnnnnnnnnnnnnnnnnnnnnnnnnnnnnnnnnnnnnatattgtagactgttagtccttaaccagcaaccaaataaacgctccaaagtagcaatgcataacgaattcctttgcctannnnnnnnnnnnnnnnnnnnnnnnnnnnnnnnnnncgtaaccaacctgcaataccacaaaagatatcgccaacaataggaagccagctaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttaaaaaactgctggcaaacataatnnnnnnnnnnnnnnnnnnnnnaaggaaaattccgagtaaagcagtcaaataatcggtcatttttgtaactattttgttaaatttgtgttttgttaagttttaannnnnnnnnnnnnttgatatggatcaagaaagaattctactttattnnnnnnnnnnnnnnnnnttatttgatgatcacttcaacaggtctataattctcaacaatttctataatttttcaaattttcgtttaaggatagtaatgttttcacctgctgagatggcaaaaatcgccgaagatggcgcagtttataaagcaaccaaaaaccaattttattctttcatttcagcaattactgctggcgcttacatttctattgcttttgtcttttatgcaactacccaagttggnnnnnnnnnnnnnnnnnnnnnnnnnnnnaaactcattggcggtcttgttttctctttaggcattattatgtgtgttgtnnnnnnnnnnnnnctttttacttcaacaaccatgacgattgttgccaaagcaagtaagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgcagatgtttaaaaactggtttgttgtttacggcggtaatttcatcggtgcgacctttattgtgctgttagtgtggtttagcggtgaaattatggctgcaaatgggcagtggggcttgactattttaaaaacagtccaacataagatccatcatacttggattgaagcattcagcttggggattttctgtaatctgatggtctgtattgcggtatggatggcgtatgcaggtaagagcctgacggataaagcgttcattatgattttgccgatagcaatgtttgtggcatctggatttgaacactgtgtggcgaatatgtttatgatcccaatgggcgtgttaattcacggctctgcaagccctgaattttggacagcgataggggttgatcctagtcaattcgctgatttaacaatggcaaattttgtggtgaaaaatttaattccagcgaccttaggtaacattgttggtggtgcatttttcatcggtatggtgcagtggtttttgcatctaaaaaaacattaattcaaaacttgtaagcggtcacttttcgcagtgtttttgcaaaatcgcaccgcttgcgttccaatttattacattaactaacgaggacttaaaatgactcaactaaccgaagctcaaaagaaagcgtgggaaggttttgcaccaggtgaatggcaaactgatgtaaacgtgcgtgactttatccaaaaaaactatacgccgtatgaaggtgatgaatctttcttagcagatgcaaccgaagcaactacaacgctttgggcagatgtaatggaaaaaatcaaagtggaaaacaaaacccacgaaccgtatgacattgattgcgatattccatcaaccatcacttcacacgcaccaggttatatcaacaaagatttagagaaaatcgtaggtcttcaaacagatgcaccattaaaacgtgcaattatgccgtttggcggtatcaatatggtgaaaggctcttgtaaagtttatcgccgtgaattaaatccagaagtagagaaaatctttactgaatatcgtaaaacccacaaccaaggtgtattcgatgtttatactccagacattttacgttgccgtaaatcaggcgtaattacaggtcttcctgatgcttacggtcgtggtcgtattatcggtgactatcgtcgtatggctctttacggtgctgacttcttaatgaaagataaagtaaaacagtttacctctttacaagagaagttagagcgtggcgaagatattcaagcgacaatccaattacgcgaagaaatcgcagaacaacaccgtgctttaggcaaaatgaaagaaatggctgcatcttatggctttgacatttcaaacccagcaactaacgcacaagaagcggtacaatgggtttactttgcttaccttgcagcagtgaaatcacaaaacggtgcagcaatgtctttcggtcgtgtttcaaccttcttagatatttatattgaacgtgacctaaaagcaggcaaaatcactgaaaaagaagctcaagaattaatggatcacttagtaatgaaactccgtatggttcgtttcttacgcaccccagagtacgatcaattattctcaggcgacccaatgtgggcaacagaaactttcgcaggtatgggcttagatggtcgtacattagtaaccaaaaacagcttccgtctattacataccctttacacaatggggccatcaccagaaccaaacctaacaatcctttggtctgaaagtttaccagatggtttcaaacgctatgcagcgaaagtgtctatcgaaacttcatctgttcagtatgaaaacgacgacttaatgcgtccagatttccaaaacgatgactatgcgattgcctgctgtgtaagcccgatgatcgtaggcaaaatgatgcagttcttcggtgctcgtgcaaacttagcgaaaaccttactatacgcaatcaacggtggtgttgatgagaaatcaggtgaccaagttggaccgaaaactgagccaattatgtctgaatacttagatttcgatgatgtaatgacccgtttagacagctttatggactggttagcgaaacaatatgtgactgcgttaaacatcattcactttatgcacgacaaatatgcttatgaagcagcattaatggcgttgcacgatcgtgatgtattccgcacaatggcttgtggtatcgcaggcctttctgttgcagcagactcactctctgcaatcaaatatgcgaaagtaaaaccaatccgtggcgacatcgaaatcaaaaataaagcaggcgaagtggttggcgtagcgaaaaacgtagcacttgactttgaaattgaaggtgaatacccacaattcggtaacaacgataaccgtgtagatgacattgcagttgatttagttgaacgctttatgaagaaaattcagaagctcaaaacataccgtaatgcagcaccaacacagtctgtattaaccattacttcaaacgtggtttacggtaagaaaacaggtaacaccccagacggtcgttgttcaggtgcgccattcggaccaggtgcaaacccaatgcacggacgtgaccaaaaaggtgcgatagcttcattaacttctgttgcgaaattaccatttgcttacgcgaaagatggtatttcttataccttctcaatcgtaccaaatgcgttaggtaaagatcttgaatctcaaaaacgtaaccttgcaggcttaatagacggttacttccaccacgaatcaaccatcgaaggtggtcagcacttaaacgtaaacgtaatgaaccgtgaaatgttattagatgcgatggaaaacccagagaagtatccacaattaacaatccgtgtttcaggctacgcagtgcgtttcaactctttaactaaagagcaacaaatggacgtaattactcgtactttcactcagtcgatgtaatttagtttaaactaattaagcggtcagattttgcaaaacttttgcagaaactgaccgcttattgtatcttacgcattaattgcgattagcagaaatgtttaaggacatttgtcctaatcgtactttatttaaaggaaaaagaatgactgttttagcacgttatcactcttacgaatcgtgtggcacagtagatgggcctgggattcgttttattttgtttttacaaggctgtttaatgcgttgtaaatattgccacaaccgtgacacttgggatcttgaaggtgggaaagagatctccgtagaaaatctaatgaaggaagttgtgacgtataaacattttatgagagcaacgggcgggggcgtaacagcatcaggtggcgaagccgtgttacaaatggaatttgtgcgtgattggttccgtgcttgtaaagctgagggtattgatacttgtttagatacaaatggttttgtacggaattattcagagctagtcgatgaaatgctagatgtaaccgatctcgttatgcttgatttaaaacagctgaacgaagaaattcataaagattttatcggtgtctctaataaacgtaccttagacttcgctcgttatttgcataaacgtaatcaacgtacttggatccgctatgtggttgtaccaggttatacggatgccgatgaagatattcatttattgggtcagtttattcaaggtatggacaacatagaaaaagtcgaacttctgccatatcaccgtttaggcgcacataaatggaaaaccttagggttagaatatgaattagaagatgtgatgccaccgacgcaagaatcgttagagcatattaaaggtattattgaaagctatgggcatacggtgaagtattagcgcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgatttattatatatgctataaacactttaataatcagctatatatttagatatttgccttctggtatgggatctaaaggaggagaaatatcaatttctgaatcttcaagtggtttttctgcttctttcatattctcttcatttgactgagttaaaggcttatcttgtactctaggcattattgaagagtctaagttttgtttgatatcattagatactttgcttgagtccaccacaggatctattgattcttcatgtactcctatattattttctatattttgtggtttttgtgtctctaaaactctagggatgtttgcaatgaaggttttttcttctttattgacaagtttacgcccaatttctacacgaggatctagccatattgctactacagcgtcattaaattctttgttaaattcttcaggaataacaatattatttaatatgaaatatcctttatcttctaaagcaatgtaactgagagaatcatctttcttgatattaggtaaaattttacgcaaacgatcaaccacattatcttgattttgcagagtgatgcctaaattagaccaagatctagctaaagaaattgcaaaatcacgcccttcaacgggcttttgatattttagagtcagcattaatgggcgtgtgctattagtataactgccagtttcagagaataatgaaatattatagattttaaatggtccccagatatagtctacatcattgatctttagccatttggcagagagggaggaattaaacagcaaagtagatatcaaaaaaaaggttaagcgatacataaattagtatttccattaaaaaatagatttatttctcattataacgttaaatccgtgattaagacatcctattatttatcatagaaaataaattataatcctataaaaatggcgtgaatggatcctaaatattgttggaaacttattgcgttttattgaaattgagcaatctagtctattgaactgtcaataactagattgcttagttacgactagccagctacccacaataatatagcgagaatttgaggcaagataattcgacaaaacatcactaatggatataccgtcgcataagagagtgctgctgcaccattgccctctttaataccatttgcaaatgccaaagccggtggatccgtcattgaacctgcaagcaatccacatagactcagataatttaatttaccataaatacgagcaaccagccctgtaacaattaatggaataaaagtaatgatcgcaccataaccaatccacgctaaaccatcattacttaataaggtattcaagaagtttccgcctgctttccaacctacaactgcaaggaaaagcacgataccaatttctcttaatgctaagtttgcacttggaggcataaaccaatagagttttttgatacttcctattcttgctaaaattaatgcaactaccaaaggcccgccagctaaccctaattttaatgcaacggggaaacctggcagataaattggaatagagcctagtaacacccctaaaccaacaccaatgaagataggcaacatttgtacttgttgtaatttttgttgagcgttaccgataatcgccatcacagcctcaatatcttcttggcgaccaaccaagttcaacacgtcaccaaattgcaatgtcatttgcccattaggaactaactcaacccccgcacggtttaagcgagaaatcactacatcgtatttcccttttaacatcaattggcgaatttgtttcccaaatactttttcattggtaacgacagcacgttctgtgcggtacattgtgccttttgtcgaaagtgaaacattcacttcttcaccaagaatgagttgcattttatgcaacgcagtttttgttcccacaagatgcagaatatcgcctatttggatttgggtatgcactttaggcacaaacaactcatcattacgcttaatacgagaataaaccacttcgtgcagttcaaaatcaggaaactcttgaagcatcaacccattcaaatttggatttgtaatacgaacgttcatcgtacttaatccatcttttttattgttggttgcagaatcaaactcatcagcttctttatccacattaattttgaaaataatacggataagccacatcgctaatagaatcccgataatcccgaaaggataggcaattgcgtaccccatacccatcacagctgtaatggactcaccgcctaattccgtcaggatttgttgcccagcacctaatgatggtgtattggttaccgcaccagagaaaatacccaatatcacaggaagaggaacatcaaatattttgtgtaataaaatcactaaaataccgcttatcccaacaatcatcacagcaaaagcattgagctttaatcctgattggcgtaatgaagcaaagaaacccggaccaacttgaataccaatggtataaacaaagagaatcagaccaaactcttgaataaagtgcaaggtatgaccatcaagtttgacaccatattgcgtcataaaatgggaaaccagtatcccaccaaataacacaccgccaataccaaggcttacgccccgcaccttaatatgccctatccatagtccaatgacagcaactaaggataataggctcactgttaatgcaatttcgctcataaaagcctcacataaaaataaaattgctataattttaccaaaatttacatataaaaaatcagatctaactcaaaaaaactacaataaatatctgtttaaaaagacatttatcgcttgtatcattttttgtctatataaattcgctggaattacctttgaatttgaaagctctttacgtacagctttcatgttagccttcttctcatctatcggcttatccgcagattttccccgtttgaaacaaggtggaatcccacttgtcattttcctcgttatcgtgagtatatttatccttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttgttcaaaatggtgttggcgttggtttagctatgctacttggtattgatccacttgttggtttaattacaggttctattactttaactggcggacacggcacaggtgcaacttgggcaactgtttttgcagagaaacatgggcttgcaggtgcaatggaaatggcaatggcatctgctacatttggtttagtagctggtggtttagtcggtggcccattagcacgccgtcttatcaacaaaatgaaaattaccccatctaaacacagtgtaaaagttgaaagcgtagaagcaaaatatgctgatgatacatttgaagatgctgacaatgtacgcttaatcacagcaacatcaacgatcgaaacaatggcattatttgcagcgtgtctagcattctcatcagttatggttaaagtattccctgattcaggtttacctcaattcgtatgggcattaggttttggtgtagtattaagaaacgtattaacgttagtgtttaaatttgatatgtttgaccgtgctattgacgtatttggtaacgcatcattaagcttattcttagcaattgcattaatgagcattaaactttgggaattagcagaccttgctggctcaatgttaattatccttattgctcaaaccatagttatggtactttatgcatattttgtgacctttagagtgatgggaagtaattacgattcagccattcttgcagcaggtcacagcggttttggcttaggcgcaactgcaactgcggtcgcgaacatgcaatctgtcacagaaacttttggaccatcacataaagcattcttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtggttaacttaggtgtaattacagcatttatgaattatttaactagctaaaatagcatagaaatcagagtggttgctaaaattatatagcaacctttgtagtcatgattgttagtctattatcaataaagagccagcaattagattatttatggaaaaaacttaatagaggctctgggttctgaatatactcagatagttcttttttactaggataaccaatataaggaatttgtcctagtaatggagcattgatttttttgctaaggagttcaattaattcagcgtagtgacgtagcccaggatttactcgatttgcaatccatccgataagattaaccccactttgttgaatcgcatccgctgttaaaagtgcatggttagcgcaaccctcttttattcccacaacaagtacgactggcattctatttttcttaacccaatcagcaaaacttaggtctttattaataggtgttaaccagccataagtgccttcaataagaacatttgcatattgtcggtgtaaacgttgaagatcgtgatccagtttattaacagaaatatgacgtactgcgtctagcgctgcaaatactggcgtactagaatggataaaagaatagctattaatttctctgtattttacaggacaagggcagctgttctgtataatgaggacatcactattgtcttcacaggcataatcatcttgattgggttctgtgggtaaagaatcatcgccaccacacgcaataggcttataaccgacaatgggaatttcatatttagatattgtttgtaatagagcccttgtaacgatagtttttcctacatttgtatctgtgcctgcaataaataaacaagacattgtattttcctgttaatgataagttaaaaaaatttttcaaattctaatctgaaattaaatttaatataatgttttcgatcaaattttctgataataaagacaatatgttctaagaaaaatgtagttaaagagaatttaagaggggattccctcctcttaaattcaataatatatgaatactaggattttagtaaaccagaggagccttctgaataatctttaggttgrtcwtcwtcagatttaggtttattttcaattttaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattttcaattttaggttgttggaaaaattcaatttttgcagannnnnnnnnnnnnnnnnnttctgaaccttgtgctaaatgcgtataaagttttttgtagtcttcagcaagtgttgcaagtagagctgcagattgttcaaagtgttgttctaattgctgtttttgctcgtccaattttttggtagtttcttttaaatcggcttcaagcttgagttgttttttgacattactatttgttgctctcacaacaacatagctaataatacaaccaacaataaatgctgcaataattgcagtccacacgttacctgaccattgttccatatgcactccttaagtggattgagtaaatgtcattaatttttatcatgttatttacaggatgaaaaggaaaagaaattcattttttgaaactatccacaaaaataaattttttatcaaaaatggttagatttttctcaaggaaatctgtataatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgtatggtattcccgccatataagtttggtctgaataagactcgaaggggtcagattctaccgtattaataggtaatatccattaggatattgggtttaaactttaaattttggtatttaattaatgaaaacttttgtagcaaaaccagaaacagttaaacgtgactggtatgtagtagatgcgacaggtaaaactttaggtcgtttagctactgaattagcacatcgtcttcgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccacacgttgatacaggtgattacatcatcgttatcaatgcggaaaaagtagcggtaacaggcaaaaaagaaactgataaaatctactactggcacactggctatgtaggtggcattaaagatgcaaccttcaaagaaatgattgctcgtcgtccagaagcagtgattgaaattgcggttaaaggtatgttgccaaaaggtccattaggccgtgcaatgttccgtaaattaaaagtgtatgcaggtaacgaacacaaccacgcagcacaacaaccacaagttttagatatctaatcacggagcataaaaatgacagcagcaaatcaaaactacggcacaggtcgccgcaaaagctcttcagctcgtgtatttatcaaaccgggcaatggtaacatcaccattaaccaacgttctttagaagtttacttcggtcgcgaaacagctcgcatgatcgttcgtcaaccattagaattagttgagttaacagataaattagacttatacatcactgttaaaggtggtggtatttctggtcaagcaggtgcaatccgtcacggtattactcgtgcattgatcgaatacgacgaaactttacgtccagcgttacgtgctgcgggctttgttacccgtgatgctcgtcgtgttgaacgtaaaaaagtgggtttacacaaagcacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtttacacaaagcacgtcgtcgtccacaatactcaaaacgttagtattacaattttatatatcctctctattaagagaggatattttctatgggctctttttagtatgatgtatctgtttagagcatagcatatatagatatagtgttatgtttagacactactagagattgataagattagcaacaatatattgtcaatcttctcccgtcattcctgattaaagctcaattcttcaatcgcctttaaacatttttgttttctattctctgtttcttgtatctttattgagagcatatgcctatactcagggtaatggtaattttgttcaatgagccatgagagtttttcattcaatgcacgcaacgctttatagtattcatgtaacttctgtttctttgataatgtatgaatactcttagtaaatttatattgagagaaaataggggaatctgactttttatccttgaggtgaatacttttttgtagagcatcatattgttcaattaaacgttgagtataaacttcagttatttcaggggaagttgactgctcaatatgtgaacatgtttctagtatttcttgtatgaattctttgacggagccatgagtaagtttaaagcagtggctatagatagagatttgcagagacaagatgggagaaaagtcgtttaattttgtaatgattgtatctgtaaaattacccattttttattctctgtattaagcgtatagatattttaatgtatgtacatctcttttcaaatttatttttgataaaaataatctttctatttttttctaaaaatgtgatgaaactcacatttttagaaaaaaggttataaatctttatttgctatgagttttttatttttaaatcatatagttatgtgatttattgcaataggagcaatattttaaaaaattatctctgaatacttgttttggggtggggatttattaacttattgattttaaagaaaatgtttttttgtttttttttatgtaagatattgacactactctacaaatttgcaatcatacgcacgcaatcggcatttaccaaacttacatgggaaggtaatggcagatatggatcggttactcttataccttaataagagtaatcttagctaaactaaaaacttaaggtgaacattatgaaaaaaacactagtagcattagcagtagcggcatttgcagcatcagcatcagctgtaacagtttatgaaaatgaaggtacaaaagttgattttgatggtcaattgcgtcttcttttagaagaacaagccacaaaagagaaaggtcaatcttcaacaggtggtcacactaacttaaagaataatggttctcgtttcggtatttctatcaaacataatatcaatgagaatctctacggttttggtcgttatgagactcgccttgacagtaattctgaaaatgctgcaggatggggcgatgttaaaacaaaatatgcttacgtcggtttaggtggctatggtcatgaaatttcttttggtaaacaagctgtaatcggtgatagcattggtcaagctggttttgataaagtatacggtgttggtactggtggaattaaatattcagcaaacaacacaaacaaaaaaggttttgatatccttactgactcttctgattcagcaattaactatacctatacaggcattgaaggtttgacgttaggtgctaactataatgttgcaaatgagcgtgataagaagacgggagaagtaaatataggttctactaaatctggctttggtttaggtgctaaatacacagctaagattgcggaaagtcaatctgtaactgtggcagcaggttatactcatgatgactataaatctggatctgttaataagaaagacaaagatggtgtatactttggtcttaaatatgtcaacgctccatttactgtagctgttgatggtggtcatggtgttgaaaaaacaggtaatgttaaagagaaaattgacttcgtaagaactggcgcaagatttgatgttactccaaaatctggcgtgtatggaaactactcttatggtacttacaaagataaagcttacaaagcaacagctcatcaattcatgttaggtgcagactataaattacataaacaagttgttacctttgttgaaggtcgtttaatcaagaacaaagacagtaataacaaaaaagttactgaccaagcacttggtgttggtttacgtgtattatggtaatctagatagttaggtactatagttaattagctatgatttaagggataagagatgtaatttcttatccctttattattagtcatttttctgctttagcgagtacttttctactgcagttaacattcctcttaataaatttaattcgttggtttccaattcggctcgttgatataaccggcgtagtttcagcataactgcttcgttgcgaataaagccaagttctttatataaacgttcggtatgggcaaagaaatgttctaaggcttctgatgtcgggtattctgcaagcggttgaatatcggttttttcttgcaaatctagccaagccattcggagttcataacaggcgagttgtaccgccattgcaagatttaacgagccatagtcggggttggttggaaagtttaagtgataatggcattttaataattcttcattggttaagcccacccgttctcgtccaaatacaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaagctggcaatctgcgattgcactgtcgaaatctggataaatttgcacattatccaatacatcttttgcccctgcggcaagggctattgcttgttcgtcaatcgcttgttttggggcgacaagccttagccggcttagtcccatcgttttcattgctcgtgcagctgagccgatattaccgctatgagaggtttcgactaggattatttgaatttgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggattatttgaatttgattaagcaacattttttatatcaatataatagggtagtgttatgtcattttagcataaaatcaaaccgcttgttcttgctttatgtaggataaatgttacacttatgactcttttttaacttaggaatgtgaaacaaatgaaaaaattgcaattaaaaaaatggttttcaagcctttttctcctttcaccattagtctttgcagcttctaatgctcaggctgaaggaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggcgtccaaaataaagtatgtgaagatctgacgaaacgtttttcacaaaaatataatgtggaaactcagtttattcacggtggaacagggacaattttaggtaagctgaaagcggaaaaagataatccacaagcggatatttggtatggcggtactattgagccacatttccaagcagggcagatggggctattagaagcctatcgttcacctttgcaagcggaggttttacctcaatttaaagcattgcaagagagcgaagcaggtaaatatacctcgattgcgtatttgatggtgcttggttttggtattaacaccgaaaaattaaagcagttaggggttgatgctccgaaaaaatgggcagatttgcttgatcctcgcttaaaaggcgaagtgcaattagctgatcctcgcacttcaggaacaatgtacacgacgatgattacgcttattcagttaatgggcgaggaaaaagcctttgagtacttgaaaaaattagatggcaacatttctcaatatgtgaaaagtaccttagtgacctctaacctttctcgtggagagagtgctgtgacagttggctttgctcacggctatgcttcagaaaaagagaaaggtgcaccggttgattatgtgttacctaaagatggggtaggttatgctttaggggctgcaagtattattaaaggtgcgagaaaccttgataatgcgaaattgtttatggattgggttctgtctaaagaggttcaagaaattccttggcgtgaccacggactttatcaaacaccaaccaatgtgaaagcagaagttgccccacaatcacctaaaatagatggggtgaaattggttgatgtggattatgcccgttttggttcaagcgaggaagggaagcgtttggtagacaaatggctctttaatatcaaattatcgaattgatcttctttatagaaggaagggatattttcattagagatgagccctagtattcattctcatagatcggagactagggcataaattatctttttaagatagaagagtattttttcagccctgtccgtaaggtacggggagaacgtcaagataagtagtatgtaaagaattataagtttggattgcaatgggacagtttaggttttgtaacaccagccatttcacttaattcatccatatgattaatggtaatatatttaccttgtaccgttatgatgccatttttctggaatcgaccaagcaagcgactgatagtttcaatggttaaacctaagtaatttccaatatcaccacgggtcattgttaagcgaaattctcttgctgaaaaaccgcgtgcggcataacgttgtgaaagattgtaaataaacgccgcaagtttctcttccgcactcattttagaaagcaacaaaatcatttcttgatcgcttttgatttcatgactcatcaaacgcataatctgatagcggatttttggcattttgccagctaaatcatctaaaatatcaaaaggaatttcgcagatcatcgacgtttcaagagcctgagcaaaaccgatatgtttcatatccataatcgcatcaaagccaactaaatcgcccggtaaatggaaagcggtgatttgctcttcaccattttcactgatggtatagcttttaattgtacctgaacggattgcgtagatagacttgagttcatcacctgactgaaagatgatttgtgatttttgcacaggtttcttacgttcaatgatattatctaattgagttaattcatgttcattgagagtaaaaggtaaacataattgactaatactgcaattttgacagtgaattgtgcaggctgttcttccatttgctttaaaatcagatacaattttcatacgaaaccatcctaaaatttgatttaaggcaaattttaacatttttttagggaataatgaacaaggtttatttatatttggagtgaaaatggcggcagagaaattgactaaaaagagattaattcaaattattgtgatgttatttgtcctgatttgcgcatttttatatcgtacttatacgtattcactaaattaggaatgttgctaaataaattattttctacaatctttataaattgcgagtagaatacaccatttactatcaataatattgtttatgtctaaagatactctattttcagcccctattgagaaattaggggatttcacttttgatgaatctgttgcggaagtttttccagatatgattcaacgttctgtgccgggctattctaatatcattacagcgattggtatgcttgcttctcgttttgtgactgatcagtcaaatgtctatgatttaggttgttctcgtggggctgggattttatcgattcggcgtaatgtggaaaaagcaggagtaagaattattggtgtggataattctgaacctatggtagaacgctgtcgtcgccatttggaagcctatcattcggatattcctgtggaaattttatgtgatgatattcgtcacgttgagattaaaaatgcatcaatggttgtcctaaatttcacgttgcaatttttgccaagagaagacaggcttgctcttttacgtaaaatttatcaggggttaaatccaaatggtgtgttggtgttatcggaaaaatttacttttgaagataacacaataaatgaacttcttattgatttgcaccacacgtttaaacgtgcaaatggctatagtgagcttgaagtaagccaaaagcgtacagcccttgagaatgtgatgcggacagatagtattgatacacataaagcacgcctaaaagaagcaggtttttcacaagtagatctgtggtttcagtgctttaactttggttctatgattactattaaataatgaaattagtgtagttgaagcagattatcaacaaattttgtgtctcgctatttttgtacggggtaaaccagctgaaaatttttggcaaattcggtaaactacctttttatcatttccctgaaaagagtttcatcaatggctgaatatcaaaaaaataaagatcctcaaaaagataaacagattgaacagataaacatcgcccctcactcaattgaagcagagcaagcggtattgggtgggataatgctgagtaacgagtactgggacagcgttgctgagcgtgttcagagtaccgatttttacaatcacgctcatcgtctgatttttgaagaaatggtttcactatctcgcaataatcagcctattgatattatcacgcttgatcaggtgcttaagaataaaggcatattgcaagatgtgggtggttttgcctatcttgctgaactgtctaaaaataccccaagtgcggcgaatattttagtttatgcggagattgtcagtgaacgggctattcgtcgtgaattgattgcggcgggtaataaaatcgcagaaatcagctataaccctaagggattgacagttaaagaagtattagatgaagcggagagatccgtttttcatattgcagaaatgcgaactgcaactgacgaagggccgaaaaaaattgatgatattttgatggaaaccttagctcgcatagaattactctctcgttctcaaaataatagcggtgtaacaggtgtatcaacgggttttgccgccttagaccgaaaaacagcaggacttcaaccttcagatttaatcattgtcgctgcccgtccatcaatggggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacaacatttgcgatgaatttgtgtgaaaatgcagcaatgggagatgttgaggtcgaagatgagaatggcaataaagttaagcaaccgaataagcctgtgctgattttcagccttgagatgccagcagatcaaattatgatgcgtatgtttgcttcgctttcaacggtcgatcaaacgcgtattcgtacagggcaactagatgatgaggaaatgtctagggttggtagtacagtgggagtgttgcaatccagaggtaatatttatattgatgatagttcaggtttaaccccaacggaattacgttcacgcgcgagacgtgtgtacaaggaaaacggtggattaagtttaattatggtggactatctacaattaatgcgcgctcctggatttgcggataaccgaacccttgaaattgcggaaatttctcgctcactgaaagccttagctaaagagttacaagtaccggtagtggcactttctcagctcaaccgtagtttagaacaacgttcagataaacgccctgtaaactcggatttacgcgaatcgggatcgattgaacaagatgcggatttaattatgtttatttatcgtgatgaggtttatcacgataatccagatacaaaaggaatggcggagatcatcattggtaaacagcgtaatggtccaatcggacgagtgccattaggcttccaaggacaatattcacgtttcaccaattacgaaggcagctatagactagaggacgaataagatgttatgtgcaatttataaaagccctaaaaaagaaggaatgtatctttatgtggaaaaacgggataaatttgaggcgatacctctagaacttcgccaaatttttggtaaacctgagtttgtaatgctgtttaatttagcaggtgaaaagcagctcaagcgggtagataatcaagaagttttgcaaaaaatccaaaatgaagggttctatttgcaaatgcctccaccccctgaaaatttatacgctgaatttgtagcaagacaaaaagggttaaaataatgcgttgtccgttttgtgctactgatgataccaaagttgtagattcacgtttaaccgcagatggctaccaaattcgtcgcagacgagaatgccctgtctgtaaagaacgttttacaacctttgaaagtgctgaattactcattccgcatattgttaaaaataatggtagccgagaaccttttgatgaacgtaaattaagaaccagtttatctcgtgcattagaaaagcgtcccgtgagtaccgatgatgttgagcaagcgatccactgcattgtgttacaacttcaagccacaggggaaagggaagttgctagtaaatttgtcggagacttggtgttaggtgaattaaagtccttagataaagtcgcttatattcgatttgcgtcagtttatttaagttttgatgatatagaagaatttagtaaagagattgagcgattaaggaactgaatatcaattaagcagagatacccatcaatgtcttattcggctctttcgccatttctcgtgctaatttcggcactaagtaacccgatgtaatgcgttgcaattcacgataaatttcaaaggctctgctatcttcaatataaaaatggctcgcccctgccactttgtctaataggtgcaaataatagggtaaaatgccgtagcgaaataatttgtcactcaaggctttgagggtttgggcgttgtcgttgatccctttgagcaagacagattggttgagcaacacgacattgctttgttttagcttctgcattttttccgcaaaaatgtcatctatttcgttggcgtgattgatgtgcgtcactaacacgaccttcaaacgactttgtaatagccgttcacataattcgtctgtaatacggttgggaataaccacaggtaaacggctgtgaatacgcacggtgttgatatgggaaatctgttctagttgggtgaaaatccagtcaatttcgtggtcttttgccatcaagggatcgcctcctgataagatcacttcttccacttcggaatgtgcttttatatagtcgaggcttttctgccacgttgctttgccacttttgacttcatcatagggaaagtggcggcggaaacagtagcgacagttaatcgcacagctattttttaccataaataacaagcggttatgatatttatgcaaaatgttaggggctggcgaatgctgttcttccagtgggtcttggacaaagccatcaacattggtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttcttgtaatgtgatcgcttgtaaaaaaaggggatctgcccgatccccctttttcattttttcggcaaaggggcgtggcactcttaacgcaaacagtttacgagcggtaagatcttgctcaaaatctgcaatgtttagctcaaggtaattcaataaatcttctggtcgattaaaggattcagccagatcttgtagccattgagctttcgttggtgcgtcgtaaaatgagatgttcaaatttgccccttttgctgatgaaattactggctaatcacacactgcattggtgcgttggttttatctaccatcaatgtcggtggtaattggctgttgttggttcctaccatatattgcacaccatttaagcagtaacgcaaataacccagtgttttttcaataaggtaagggtcgttttgcggatcgattgctttaaaggttggcacggctggtgcctgttgtacctgtttggttaattgttccgttggattggttgctggtgtttgagcctgtgcttccgtcggggaaagagcttcacttaataagtaacctgccgccgcccctgtcacaaaattgcctaaccggttgccctgcgcctgttgagcagcaccagcatttggcattgcttgatttggcgtattattaaagtccgcatcggctttttgttgtgttgtggactgctgaaccgttgctggtgtttttttgcttgaagaaaatttcattctacctgcttttttcgcctgaacggttgaaacgctaagggcaagaactaagcccattaacactgcttttttcattttatttcctcattgattgaaaaggtgaattatacctgaaacggctttatccgccatacttaagaaaaattttaattttttgcctgccatttttagtgtattatatatgcctttttatttagccctttgggcgttactttttatctaaattctgaggatcacaatggctagttacagcactaatgatttcaaaccaggtttaaaatttatccaagatggtgaaccttgcgttatcgttgaaaacgaattcgtaaaaccaggtaaaggtcaagcatttacccgtactaaaatccgtaaattaatatctggtaaagtattagagatcaacttcaaatcgggctcaaccgttgaagcagcagacgttgtagattacaactacacttactcttataaagatgaagatttctggtactttatgcatccagaaacgttcgagcaaatttctgtagatgcaaaagcattgggcgacaacgacaaatggttggttgatcaagcagaatgtatcatcacattatggaacggctctgcaatcggcgttactccaccaaacttcgttgaattagaagttatcgaaactgatccaggcttaaaaggtgataccgctggtacaggtggtaaacctgcgacattaagcacaggtgcagtagttcgtgttccacttttcgttcaaatcggcgaagttattcgtgtggatacccgttcaggcgaatatgtttctcgcgtgaaataatctcgcaatcccctgacaatttgttaggggatttttttatcttcagctagccaatcttcgtaatttaataatggtacacgtttaaattctttgatatgttgataattaaacgtaggatctggctctcccaattcatctaaccaattccaattatcttcaattggctcaataattgcctcattacttttcttctcaattttcatttcatctcatctccgtactaggtactagaccgctaacaaaccatatattaataggttaaatattgtagggtaggttttaatccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgattatatggtgggtcaagacccaccctacaagctactttaccactaatctaatatctaatttttgatagacatatactacccctaattgagaaagttacaaaaagtttatgtctaacaatgtgcttttttatccataaccccgaactttataatgaaaatttcttctaagtaaggtaaaatctttacactttcattactactcactagaggaacatattatgtcagtcgcaattttagaccaacttgaagaaaaaattaaacaggctgttgaaaccattcaattacttcaattagaagttgaagagttaaaaggtaaaaacgaggaagctaatcgtgcaaatgaaactctgcgtcaagaacacgagcaattaaaaactgaacatcaaaacttccaagatcgtttacgctctctgttaggtcaaatcgacaacgtttaatctttgtttgaataaacggctaatacttttgattagccgttttttattacttcatttattatggctaaactctatttttattactctgcgatgaatgcagggaaatccacaactttgcttcaatcatcttataactatcaagaacgaggaatgaatacccttgtttatactgcggcgatagatgatcgttatggcgtagggaaagtctcctctcgaattggtatttcacaagatgctcgtttattcaaaaacgatagcaatttatttgatgaaatcaccgcttatattgccgatgaaaaattgcactgtattctgattgatgaagcacaatttcttaccaagcaacaggtttatcaactgactgaagtggtcgataaattaaaaatccctgtgctttgttacggcttacgcaccgatttccagtctgaattatttgagggaagtcgctatctactcgcttgggctgatcagctcgaagaactcaaaaccatctgttattgtgggcgtaaagcaggctttgttattcgtatgaatgagaaaggtgaagcggtaaaagatggagatcaaattcaaatcggtggaaacgacagctatctttctgtatgccgtttgcattataaggaaaaattggggatataacttagtttctatctatttatctgaataggaatgaattgccaattatatttcaaaggtgaaaagcatgtaggatacagtgattgctttgttttaggggaagcacttgtaataattaataacggaagaatgtaaaatgagcgaagctgtaatttttgatatggacggtacgttaattgattcccaacctatttggtatcaagcaagtactgaattttttcagaaaaatcaatttcctgtaaccttagctgaaatgatgactcttacagggtcaccagttggtacgcttgttgattatgtgctacaaaaatatggcgaaaaagaaaagagccgtactcagttaatagaagagttgatggcatatgtagttggaaaggtgcttgaagcgaagccgttaatgccaaatgtgaaagatgttttatctaccttaaaacaatgggggattaaaatcgcagttgcttcggcttcaccaagaaatatgctacaaggcattgttgatagctgtggtatagctgaatattttgattatttagcttctgctgaggaattggagtacaacaagccacaccccgctgtatatttacacgcagcaaaacaacttggcgttccaacatctgcctgttttgccgtagaagattcggttttaggtatgatttcaggtaaagcagcgagtatgaaaaccgttgttattcctgcaaaatcggaatgggacgaccctcgctgggctttggctgattataaattagtgagtatgtcagaattaccgatgttaatagaatcgtaatggtttgatgtaaatcgtaaagtcccctattgtatggggagcgttttggggaaaaatatggatagacataatttctcaaaactttttctttaatccccccactttcgctataatagcccaaattatttagatcaaagagaattcaaatggcaacaattgcaaaaaatctgctcgttttagtggacggttcgtcctatttatatcgtgcattccacgcatttccccctttaactaacaaacaaggtgagccaacaggggcgatgtatggggtgctgaatatgttaaaaagcctgattgcacaggttgagccaagccatattgccgtcgtgtttgatgcgaaagggaaaaccttccgtgatgagctgtttgaacagtataagtctcaccgtccgccgatgcccgatgaacttcgttcgcagatccaaccgttacacgcaataattaaggcattgggtattccgctgttgtcgattgaaggggtggaagctgatgatgtaattggaacgcttgcagtgcaggcttcacaagcaggtaagcacgttttaatcagtacgggcgataaggatatggctcaactggtaaacgatcatattatgctgattaacacgatgaacaataccttgttagatcgtgaaggggtgattgaaaaatatggcattccgcctgagttgattatcgactatttagccttattgggcgactcgtccgataatatccccggggtaaaaggtgtgggtgagaaaacggcgattgcgttgttgcaaggtattggctcaatgcaagcgatttatgcgaatttagacaaagttgcagagttatcatttcgtggggcaaaaacctttgcaccgaaactggaagcagaaaaagaaacagccgatctctcttatctattagcgacaatcaaaaccgatgttgctcttgatgtcacttacgatcagcttgttactcaaccacaacagcgagatcaactggtagaactctttggtcgttatgaatttaaacgttggctgaacgaagtgatgaatgacgctaaccctgtgacacaaacgtcagcagagaaaatcccgaacaattatcaagccacacaagcggtcagttcagaacaaaaatctgcaccttttgtaaaaatttcgatagatcgcaccgcttacgattgcgtgaacagccctgagctgtttaccaaatggctggcaaaattgcaaatggcacagcttgtggcggtggataccgaaacggataatttagatgcaatgcaagcaaatttagtcgggatttcatttggcttggaaaatggcgaagcgtgctacattccgttggcgcataaaggcaaaattacacagtcgacccaagtggatctgtttggtgaaagtgaagcagaactcgatgaagtcgaagcgttactgcctaaccagttgaacaaagcggactgtttggcacagttaaaaccgattttagagaaccaaaatatccgcaaaatcgggcagaatatcaaatacgatttaacaatttttgctcgcaacggcattgagctacaaggggttgcctttgatacgatgttgcaatcttacaccctagacagcacaggtcgtcacaatatggacaatttggcagagcgttatttgggacatcaaactattccttttgaagagttggcaggtaagggcaaacatcagcttacattcgatcaaattgaactggataaagcaacagaatatgcaggggaagatgccgaaattacaatgaaattacatcaactcttatggtctgaactacaaaaaacgcctgaattggtgaaactgtttgagcaaatcgaaatgccgttggtgagcgtactttcccgtgtggaacgaaacggcgtattaatcgatcctgccaaactgttggcacattcggtagagattgaacagcgtttaaaagagcttgaaacccttgtacatcaagaagcaggcgaagtgtttaaccttgcttccactaagcaactgcaagagattttatttaacaaactcggcttaccgattttaaagaaaaccccgaaaggtgcgccatcaaccaacgaagaagtgttggaagaactggctcaaatgggacaccaagtgcctgtgctgttgatggaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcgtggcttgagcaagctgaaatcgacctataccgataaactaccgcagatgattaatgcacaaacaggacgtgtgcatacttcatatcatcaagcggtcacggcaacagggcgactttcatcaagcgatccgaatttacaaaacattccgatccgcaacgagcagggcagacgtatccgtcaagcctttattgcccgtgatggctatgtgattttggcggcggactattcgcaaattgagttacgcataatggctcatcttgctaatgatgcaaatatgatcaaagcctttgccgaaggtaaagatattcaccgttctacggcggcggaaatttttggcgtgccgttggaagcggtgaccagtgaacaacgccgtagtgccaaggcgattaacttcggcttgatttacggaatgtctgaatttggcttggcaaatcaactgggcatttctcgtaccgatgcgaaaaaatatatggaactttacttccagcgttatccagccgtgcaacagtttatgttagacattcgtgaaaaagccgctgaaaaaggctatgttgaaaccctatttggtcgccgtttatatttgcctgaaattaactcaagcaaccaaatgcgacgcaaagcggcagaacgtgttgccatcaacgccccaatgcaaggcacggcggcagatattatcaaagtggcaatgatcgggatcgatcaagcggtgcgaaactgcgaagatattgcaatgattatgcaagtacacgatgaattagtctttgaagttaaagccgacagagtagagcattacaccccactgattaaagccgaaatggaaaaagcaattgagcttaaagtaccattgattgcggaagttggagttggaagcaattgggatgaggcgcattgataataaaggggactaaattagcgtccccttataactatttttaatgaatccaatgagctaaatttatttagtcatcactactaaatactcctaaaagctgtaataagctcacaaataggttgtagatagacacatataaatcaacggttgcacggatatagtttgtttcaccgccgtggataatgttgctagttgaatataaaattgcagccgttgagaacactacaaataatgcactgatcgctaaacttaacgcgggcattgctaagaagatatttgccacaatacccactaataacaccacgaacaatgcaatcatcattcccgataagaaagacatatcacgtttggtagttaatacataagcagaacagccaaagaacaccaacgcagtcgctcctaaagctaatgcaaccacatcgcctaagccgttactaatatatgcatttaaaattggacccaagctataacctaagaaacccgttaacgcaaaaacacttgctaaccctgctgcactatttgccgttgcattggttaagaaaagtaagccataaaaaccgactaacattccccaccaaggtaaacgtggtaaattaagtgtcattgtgacagatgcaaccactgccgaaaatacaagcgttaacgcaagtaagaaataagtattacgtaatactttatgtgtgctaagaagggattcacttcttgtggaagtgactaaacgatcttgcatagaatctcctgtaaataaatagtttttgtgttaaaaacgcccacaaattagcgagaaatcatagaaaagtcaatgtatttcacaaaacaaagggcgtatctctacgctcttactcttttactgaactgccacaacccttccttcttgataatccactgtcacaggactattcggcaacaatttgccagagagaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgccgatatgatcaactgccgcatcggtcaccgtcacttcatagccacgctccgccatacgtttaattagacgttcaagctgtattcttgcaatcgcacggatattttctttatctaatgggtggaataccacagtttcatcaatacggttgataaattcagggcggaaatgttgcccaaccacattcatcacgatagttttcatttcatcgtaactcatattttccgcattctcttgaattaagtgcgaacctaagtttgatgtcataattacgaccgtattacggaaatctaccgtacgaccttgtccgtcagttaaacgaccatcatcaagcacctgcaataaaatgttgaatacatctgggtgtgctttttctacttcatcgagcaacacgaccgaatatggacgacggcgaactgcttcggttaagtatccgccttcttcatagccgacatatcctggaggtgcgccaactaagcgagatacgctgtgtttttccataaattcggacatatcgatccgcaccatcgcatcttgatcgtcaaataggaagttggctaatgttttgcaaagctctgttttccctacgcctgtcggtcctaagaataggaatgaaccgatagggcgatttggatcagacaagcctgcacgactacgacggatcgcatttgccactgcatcaacggcttcactttgaccgatgacccgtttatgtagcacctcttccattcgtaatagtttctctttttccccctccatcattttggatacagggatacccgtagctttagacagcacttcggcaatttcttcatcagtcactttggtgcgtaacagatgattttcaccgccctcttcttcacgttttaccgcttcttgcaactgcttctcaagggccggaattttgccgtattgcaactctgacattttttcaaagttattctcacggcgagcctgatccatttcaattcgggcattttccaactcggttttaatgtgttgcgtgcctaatagagcggatttttctgctttccatacttcttccagctccgcatattcacgttcacgagcggtcagatcctcgtctaattttgcaagacgctgacggctggcttcatcttcttctttctgtaacgcttgacgctctaatttcaactgaatgatacggcgttcaagtttatctaacggctctggtttagagtcgatttccatacgcaagctggaagccgcttcatcaattaaatcaatcgctttatcgggtaactggcgatctgaaatatagcggtgcgaaagggttgcagctgcgacaattgcaggatccgtaatttgaacgtggtggtgaatttcgtaacgttctttcaaaccacgcaaaatcgcaatggtgtcttccaccgtcggctcatcaaccaacactttttggaaacgacgctccagtgctgcatctttttcaatatattgacgatattcatctaaagttgtcgccccgacacaatgcaactcgccacgagcaagggacggtttcaacaagttacctgcgtccatcgctccatcggttttacctgcaccgaccatcgtatgaatttcatcaataaacaggatcacttgcccttcttctttggcaagttcatttaataccgctttcaaacgttcttcaaactcaccgcggtattttgctcctgcaattaacgctcccatatccaacgacaatacccgtttgttcttcaaaccctcaggcacttcgccattgacaatacgttgtgctaaaccttcgacaatcgccgttttccccacaccaggttcaccgataagcactgggttatttttagtacggcgttgcaatacttgcaccgtacggcggatctcttcatcacgcccgatcacaggatcaagtttgcctgccttagctcgctcggttaaatcaatagtatatttttgtaacgcttgtctcgtttcttctgcattttgattattcacgctctcccctccacgaatttgttgaatggcggctgtcaccttctctttggttaaacctaagtttttcaataacttgcctaaatcaccgttattttcaagtgccgcaagtacaaacagctctgatgaaataaagctatcgccaaactgttgcgacaacttatcgcattgatttaacaaacggaaaagttgttgtgacggctgtgtattgcccccttgcacctgtggcaaacggctgatgatgccatcaagttcactgcttaaacggttaggttgcacatttaaactggtgacaagcggtgtgattgatccatcattttgctttaacaaggcaagcattaaatgggccggttcaatatagggattatctttgccaacggctaaagattgtgcatcggcaattgctgattgaaacttgctggtaaatttatcaatattcatagtttcctctaaattctgtttattaatgttctgacttcgagattactctcgcttgacgaaactataaattgggattgtcaaggggatttcaagagaaaatgtgaaagagatcacaaaattatgaaatctattgggggaagagcagctttcaagaagctaatgcatggtcaatttttatcagtattcaaacgatgaaattataggtctttaaatacgtttaaaatttacacttaggaattcccgcctcttgaggcggggaggatatcagaataaaacctatccgcttgtagtttaaattaaggattagtgacttaacattttgagcaactcttttggctcaacatagccagcgattaactcaccttcttttgtgacaatatttggcgtacccgtaaccccaaatttaatcccaagttcataatgttttttcacaatgtttggtgttttcacctgttttggtaagttacctttctccgcttcgtttaatgcaaaggctggatctttttctgtccaaatcgcttccatctgttttgcagtttcagtattcataccaccacgagggaaggctaaataacgaatagtaatgcctaaatcattatattctttgatctttgagtgcaataaatgacaataatggcaagtaatatccataaacacagtgacaacgtgtttttcatttttcgcaggataaacaatcatctcttttgctagactattaagttctgcgagtaatgcacgattagtaatatcagtaactttgccatcttttaattcaaaaatctgcccgtgtattacatagcgtccatcattgctaatttgcacaacaccttgatcagaaatcgctgttttaaaacctggcaaggcagattctgacaacttcacattggttgccccaattttctcaagctgttgctgtaagtttttatcattcgcctgtgccgtacctaagattgcaaggctaattagggtcaatagactttttttcattataaatccttctagagtttaagttttgtttcaatattccgtgctttcactaagaatgctttacgttctttatcgggcataccagatcctatacccggcaattttactgtcattggattaaccggtcgcccattgatatgaaattcataatgcagatgtgcacctgttgaacgccctgtatttccagacaacgcaatgcgttgtccttttttaacactttgcccaactttaactaacgaacggcttaagtgcatatacaccgtagtatattgccccccatggcgtagtttaatataacgaccagcaccgtttgcttgataagcgatatgttcaaccacaccatctgcaggggcaataatcggtgttccagatcgaacagcaaaatccacccctttatgaggggcaactcgtcttgttaccggatgtaagcgacgaggattaaaatgtgatgaaactcttggtgtgaatggcaatgggtggcgagcaaagcctttacctaacgtttcaccgtgacggttataataacgtccattatctgcttgaatagcataatagcttttcttgccactgataatatgaatggcttcgacatttcctaaatccgtgaccttgccattgatatactcacgctttactaaaattgcaaatttatcgccttttttcaatttattggtggcaatctgccattgcagaccgttagctaactgattgatttgacgttgagataaacctaccgcttttaaacttgcactaaaactgccattaatggtgcctttaatcacatcttgttgccaaacgccttttttctgaattgtttgtaccgcaaattgatcttgagctttacgctcaaaaattttctcttctttttctgagatgagccagttcatatattctagctcaccgttattgtctaaaatccagtagaattgttgtcctactttaagatcggctaactgtggaaaggttttttctaaggcttttgctgtggcatgtgttaatcctgactgttctagtacatcttttagctgatcgccttgagttacggtataactaaactgattttggatacgtaatgcttgatctgcaatatctaacacatcttctaatacattttctgcttcttccgataatttttcactttcaggaacannnnnnnnnnnnccttctatttcatcatcaacatcactcaattcatcttcataagaggttgcattttcatcaacaggctcagcatttacttgttcctgttcctctttagcagaggcagtaaaatcaatgctgatatacttaggctcaccatgagataatcctgttgaaacttcaggcaacgactgagtagccaacgtaatcgggatttcttgagcctctgaagaatttgaactcggtctttttaaggttaaagcgataccgataaagatagataatataatcaccaaaaacacaaatgcctttactctattcttcttacgacggcgatctctagcaaaaataacgtgttgcaaaattctatcctaaataatttcttctatgcgaacttgttatagacaaaggaataggcaaaaaattcccatagatttcttgtaaaactgaaaaaaatccgctaattttaattccttaaatccttaaatccttaaatttattaatgttatgcagatcaagcaaattaagccgatccacaatttaacgaagccccttgtgcaactgaaagcgattaatgtgaattttggtacacaagttgcccttgaaaatattcatttaaacatctaccccaattctatcacaactatcgttggtcctaatggggggggtaaatctaccctattaaaagtattgctgaaattacagccagcaacatcagggcaggttattcaccaaccacagctaaaaattggctatgtgccacaaaaattgcatctggatcactctattcctattaccgttgaaaaatttctatatctcaagcctaacagcactaaacccttgatagatgaagcattgtccctatttgcaatcactcaccttgctaagcatagtatgcaaaaattatctggcggtgagttacaacgagtactgcttgcccgtgcaattttagatcgtccacaactgcttgtcttagatgaaccaatgcaaggggtggatattacagggcaaacggaactctatcaactattaaataaaactcgtgaatggttaaactgtgctattttaatggtttctcacgatttaaacattgtaatggcaaatacggacgaagtgctatgcgttaatcgccatatctgctgtgctggtacacctgaaaaaatttcaagtgacccaagttttatctacttctttggcgatcaatttgcgaaaaacgtggcattttattctcatcaccataatcaccaccacgacttacaaggcaatgtatgtcgttgtaacggacatcactaattgaggcaatatgtttgagattttatttcctgcgtggttagcaggcgtatttttaaccttcatcaccgcaccgcttggagcttttgtcgtctggcgaaaaatggcatattttggtgataccctctctcactccgcattacttggggttgcattaggaattttcctacaaatcgatccctatattgctgttattctaatgaccgtcatactcgccctttgcctcgtctggttagaacagcactctactcactcagtcgataccctattaggcattatcgctcattgcagtttatccttaggcgttatcaccatcagcctattagacaatgttcgtgttgatttaatgtcctacctatttggtgatcttcttgcaattggttttaacgacgtactctttatcggcatcggggttatcggcattgcgacactactggctctgtattggaaaaagctactcgccatcacagtcagccctgaattagctcaaattgaaggcctaaatgtcgcacgcctacgcctcttattaatgttgcttaccgcattaagcattgcattaagtatgaaatttgtcggggctttaatcatcacctcactactgattatcccctctgcaaccgcaagacgctttgccaaaacacctgaaacaatggttatttacgccatcggattaagcatattatcggtcagtggcggactattactctccgccctcaaagatacaccagcaggaccttcagtggttgtttgtgcaggaacactctttttactctcattaattaaaaaagaggcgaattaagatcaataaaatataattttcctattgaattttttgtcaaatttcgcttaaatctcaccgcttgttaatgataacaagcggtgggatttttatatttttttgaagtaaataaagaagtaaattatgtgtcaattattaggaatgaattgtaatacgccgaccgatattactttctcgtttgaaggatttcgacggcgtgcaggtttaaccgaccaccataccgacggcttcggcattgccttttttgaaggcaaaggtgtgcgtatttttagagacaattgcccaggtgcctcatcaccaatggcagatctcgtcagtcaatatcgaattaaatcctttaacgttatcgcccatatccgtaaagcaacctgtggcgatgtcaatttagaaaatacccacccatttatccgagaaatttggggtgaaaactgggtattcgcccacaacggcacggttgatgtcaaagtttgcccgaataatcactatcagcctataggctcaacggactctgaagccgcattttgctgtatagttgccagcctaaaacaacgttttccacaaaaaccaagtgaaaaagagatttttgacgcaattgtagatattgccagtgaaatcgctaaacacggcgtatttaattttattctttccaatgggcactggatgatcgcacgttgctcaacaaacttacattatatctgtcgcaaagccccattcggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcattgcgtgatgatgatgtaatgattgatttccgtgaatatacggaagaaagtgataaagtcaccattattacaacccagcctctcacaaaaaatgagaactggacaaaaatgaaaaatgggggctatgtcttctttaaagatggtgatgtactctttgaaattgaaggtacactacctgaatgtaaacctcacgtttaaaatagattgcccctttctatactcaaaaggggcaatttacttttttacttaatcggcgttgccgtgcgttctaacacttcgagcaactcactgatattctgtttaccctgtgttttaagccactggcgagcggcttcaacaccttcggctttataggcttctgcaccgcctgcccaagtggcacgtccgcacagtacgccgttaaattgactgcctgcttggtgagcaaattcaagggtttgttggaacagtttggctgaaacgcctgcacttaagaaaataaacggcagatctgttgcttcgctttgctctttaaagaattccgccgcttctgcttggctgtaaagcacttcaccgtcagtaaagccttccacatagctcatcaccacaggcacttccactttcaacacatctaccccaaaacgtttgtccgcaaagaacttcatcgcttcaatcactttgcgcggtttcactttggcgttatagactttatcttcgtttgagccatcgtaggttaaaatttctaagaacaacggaatttgttccgcattacattccgaagcaacacgttcaacaaaggcagctttgcgatcgttaatttcgtgtggttcatcaatgtcaaaatagatcaacaatttaaccgcttccgcccctttttcttttaagcgatagacggacacatcatcaatcaaatcagggaaacgacccacagcggttttatcatagcctgttttttcgtatgccataattaatccgcaatttgcatcacgtttctctgaagccacccagccaaattccggatcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccggatcaagcaagatcgacgacgcatagggggttaattcttgagagatcaaagttttaaattcgctgacctgctgagcggtaatatcatcgcccatcattcggcgtaacgcaccacgttggtcaatcgcaagagcagcaataatgccctctttggtgcaaagttttttcattaaatcttgtttagacatactactactcctattcatcatcgcctaacgctaagtttttaagttgttgagccacatcgtgaatttgttctttggcattttccagtaagccatccgtgccatcttcactcacatagctaatcaccatcggtaaattcattccgctatataaccctgataatttcggcaagtaacgcattgccacattacacggcgtaccgcccataatgtcgcaaaaaaccacaatctcaccgcttgcattcgccagtgcttgctcaaatttcacttggaaatcttcattgccttcgtgtgggtataagcagacggtttgagcattgtcgattttgcctaaaatcatttcggcagtatccagtaagccttccgcaaactctccgtgactgattaaaattaagctcatagttgctccttttggtagttttgaattttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatctttaaatccccctcaatccccctttttcaaagggggaagtttgacgatattttttgggttatccttataaattcttagtattcaactctttataaatcggcttatcgctaaatgttaagctatcgatcttcaccccttccgtttcaaagacgataatctcattctcgcctttgtgcagtaacggtgcaggcagatagagataacaagtcgggccttcattccagtaacgccctaagttctcaccatttaccacaatcacccccttgccgaatgcacgggtatcaataaaggtatcttgcggttcttggtctaggtgtaacttaaattgatagaacgacggggcttggctatctttttcgccatcaaaatcaatctcttccaagcggtcaaaatcaatcgcataatgttgccagcctgtgtggaaatgcagatcaagcacagcccctgccccgatacctttatgttgtgtcgctgcaagtagcttaccgccgtaattcactcgtcccatattttccactaacagatcaagttggaactcgccatttggtgtctgtaacatcacttcattgccgatctcgtgttgatactgggtggcaactttttgtttatcgttgaaaatctgaatgcgatctctgccttggtaaattctcagcttgatctcaccgctatatgctgtcggtttggctcgataaagcagataaccgtagtaatgccctagttgttccattgtttgagtgaaggggctttcatagcattcgctgattgtgtctaaggtaccaaacagcgacacttcattttgcactgcaagcggtgggtaagcggtgatatttggcaaaatcggatcgacaatcggactggcatcgggatactgccctagcactttttgtagcaggtagaatttctctgacggttcaccccattcgtgaacaggggcatcatagtcatagctggttacttgcggtaaatcggtgtctaaccgtgcggaacagccgttccaaaagccaaaattcgttccgccttggaacatataaaaattgatacttgcccgttcgagtaactctttggtgcagtccgctaaatcttgagcatcacggcggatcacaggctctttccaacggttaaaccaaccgtcccaaaattccatacacatcaacgggtaagatttgccatgcttatcaatataacgttgcaactcatctaaattttcattggaacgagagccgaagttccccgtcggcaaaatatcatcttcgatcaacgcccctgcttctaaggcgttctgccacgcaccgtctgacgtgaaaagcggtacgttcaccccgtgaattaacatcaacgcccgaatagctcttaggtagtttttatcattgccgaacgagccgtattcgttctcgatttgcatcattagaatattaccgccttgggtaatttggtaaggggcaatgcgtggaagcagttcttgaaaatagcggtcgatttcagcgataaacagcggatcgttttggcgtaagcggatatttggaatattgagcaaccacgcaggcaatccgccaaactcccattccgcacagatataaggcgttgggcgaagaataacgtacagccctagatcttttgctgtttgcaaaaatttgactaaatccgcccgcttgctgaagttaaattgatcaggctgtggctgatgtaagttccacggcacataggtttctaccgtgttacaccccattgcctttaagttatagagcgttttgtaccagtattctggcacgatacgaaagtaatgtactgcacctgacaggattttgaacggttttccattgagtaggaaatccttttcgccgatttggaaaggcatagttcacctcgcttaaaagatataaaaccgaataaatctagagaagagcgattgggttttagatcttggttatttgtaacattttgaatgaatttgaccgcttgttttaggacgccaagcgtggcgtcgctacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtagggacacgacgcctcgtgtcccttttaaattaccctttcgccaacaatccagcccaagagagcaagatacagagtgcgatgatgatcataatcgctttgttagagttcattttcggtctgccgagtaaccagtagatgaagaacaccactaacgcagggactaatcttggtaagataagatctaagttcgcttgggcggaaacgactttctcaccgatagtagcgacaaacggtactttgacattcaccatcgtggcacacattacccccacaacgaataccccaagcactgttgcggcgttggttagtgcgttcaagcggtgacttaggttggtgactaagtttaccccttcacgataagcgattttgagttgcacccaacggaataccattgtggcaatcgctaccgcaacccataagccgacaccaagcggattgccgtttactgccattgttgcggcaatcgcccccataattgctgggacaagtgagccgaatagggcatcaccgatagcggcaaatggtcccattaaacctgatttgatacctgcaacggcttcaagtgatttcaccccttgtttttcttcaagagccaagtcgatacctttaacaatagtgttaaagaatgggctggtgttgaagaattggttgtgcatcaccatcattttttgtaattcaggtgtgttgtcgccgtacattttgcgtagctgtggcaacataatccataaatagccagagccttgcatacgttcgtagttccaaccaacttggttgaagaataagttacggatattgatttggcggaagtccgcatctgttaatttatagccttttggatttccgacttgttgattagagttcgtcatcttcaatttctcctttgtcagaagtggtattttgttttgcaactggggctgagccaccttctacgctacgttggtaaacaatgtaggcgaatgcaaatccgattgctgctattgcaagcattggtacgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgattgagttgcttacacctgttgatgcaccgacagcattgatgttaccgaagagagtaatgaagattgctgtgagtgagaatgcaaggattaagtatgcaatgtgacgttttgttggtaagtaacgaagtaagattgcgaaacctaacgctggtaatacgccacctgcaagggttaagccatctgcgataacttttaagaagcctgtttgcattgcttctgctaggcttgccacaaatggaccaccaaacactaacgctaagaagattggtaatgcacgagatagaccccaagcgattgcaccgcagagatagtttactgtgattgcactataagcgtggtcttggatatttttgtcgatacggtgagcgaagaatacgttagacattctcgctaaaatatcggtataaaccattaacgctgcgattggtacagctaaggttgttaaggctaattgtggatccattccagctgcaacagagaatgcagttgcgataacagtacctgagtttgcatcaatacgagatgcaccaccgaaggtacctacacctaaaatggttaattgcattgaaccaccgattaacaatccagttgtcaaatcgcccataattaaacctgtgataaagcctgcaaacacaggtgaaccagcactagatacaatcgtgatttcatctaggatttgatagaacgcataaagcgttatcaaaagtatttgccaccattcgatcataatcgttactcctctataaaagtttcattaaatcgactttttcttcattaggcactaactgagcggtgagcttcacgcctttttcagaaagttttctaaacacttccacatcatcttcagtaacgtgtactgtttttcggataggacgtgttagatccgttttaggcatattccctgcattgacttccggcagatttacgcctgcctccacaagctgtaagatcgtttgtggggttcttgttaccaacaaaacacgttgagagtcataacgcccttcgttaatgttggcggctgctttttccacaggcaacacgcttaaatttacccctgccgggcaagccaagcgtaagcctgctttatcaatgtcattatttgccgcgacttcatcgacgaccataatgcgagtgatattgagataagacgtccataagtttgccacttgaccgtggattaaacgaccatcaatccgtacatttaaaattgccatttttgcctcctgtatatcaatatggataaatcgttacaccttgcaccacacgattaacctcgcctgtcggacaagggttatccgtggtgtagccgagatagagcgagctataaaacgagtaaagttgcccaatcactaagaatgggaaaatccgtgctgcgtcatctaatttgtgaatttcagctcggatcgaaccgcttgtatcgcctagtaacaccacttctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtgcggtataaggttgctgagataagaagataaaaatgagcgtttcatcttgaacaagggattttggtccgtggcggaagcccattgacgactcaaagaagccaagacgttcaccagcggtaagttcaagcagttttaaagacgtttcacgggcaagcccttggaaatgcccactgcctaaatagacgatccgttttaatggcagatgggctaaacgttggatttcgagaagatcctgttctaataactgctctgttaccgatannnnnnnntcaacccagttatcatcaaacacatcaggtaaaaatgctactaatgcggctaacatcatattgctggcactggaggtcattgcaaaacctttatcgtgggttgattctggtaatgctaatgggtaagcggtcggatcttgctgacattttttaaataatgccccattgacattattcgttatggttaaatggtacgcttcctcgacaatctcatcgacaagctctactgcaccaatactttcagggctattaccagagcgagcaaaagagactaaaagtgttggtttatctgaaaaaagatattgataaggattggatacaagatcagtacttgcaatcgcttcgacagcacaacctaaatgctggcttaatatcggtgcaacaacctcaccaataaaagcggaagtaccagcccccgtaaaaataacacgaagttcgccttgttttgcatattcaacaagaggctgaagaaatggaataacaagtgacgatttcacaatagaaaccgtttcacgccaggtcgctggctgttgggcaatttcctttgccgtccaaaaagcgttctgtttttctaatgtttggttagctatattgaggatcattgcatttccctcacaaataaatggatttatttataaggaaagagaatgaaactacgcaattaacacttgcaccccgacattttcgagatactctcgataacttagaggaattttattatccgtgactaacacatctatttgattggcttggcaaataacaaaatggctatattgaccaaatttgctcgaatccgtcaccacaatcacctgatccgccgcatcgcacattaagcgatttagctgagcctcttgctcgttaaaggttgtgacccctttttgtaagtcaaaaccatcaacacccaaaaagactttatcaaagcgataatgttgcaaattattatccgccattactcccgaaaacgacatcgcatttttccgtaaaaccccacccgtcattcttacttccacattcggacaagaaaccaacgccattgcgacatcaagcccatttgtcaatactgtcaagttaagatcaccgatagcacttacgattgctttcgttgtcgttccagagtccaaaatcaccttctcaccctcttttaacaaagaagcggcaagatgaccaatctgttgtttgagttcgggataattattacttttatccgcaatagaaagttccgctattaatctggagtttaacactgcaaaaccgtgcgatcttgtaatatagccttgttgctctaacacattaagatccgaacggatagtaaccgtcgaaaccccgaaatgctgagacaatgcttcaactcgatgactgcctgttttttgcaataacgccaaaatatcagaacgtctttctacgctacttttcattttctctcctacatcaaaacaaccactgcatactacgattgctttcgaaagtaagtttatacctcttaaaaacaaaaacaatcgaaaatattcgaaaatgagataaagatcacaaaatttacatttggtgttttaagcaagaaaatgttttgtcacgtttatagtaatttgggcttggaaagtttcctactatacttctataccaagactaagtgattgtgatattcgtgctcaaaatggttactatcattttgagttatggtgatataatcaaagtaatcaatgatgaactttcagtaacttattgattgataatgaattttagataaagagagatgttatgacatattggttcaaaaatgtaatgatttaccgtttaaccagtgaattacgcttcactagcagtgaattagacgcacaattacagcaaacaaaattcaccccttgccaacaaagcgatatgcaaaaatttggctggtcgtcaccgcttgcaggaagtgaactgttgcactttgcacagggtcagcagttcctactggtttctcataaagaagaaaaattattgccagctcacgtcgtcaaaaaagaaacggaaaatcgcattgaagccttagaacaaaaagagcaacgtaagctgaaaaaaacggaaaagcaggcgatcaaagatgatgttgtggcaatgttgttgcctcgtgcgtttagtaaacaccaatttacggcgatttggttagacttagataaacagctcgtttatgtagatagtggctcggtaaaacgtgccgaagatacccttgctttattacgcaaatcccttggctctctgcctgttgtgccgatttccttcacgctacaaccgagcgaagtgatgacaaattgggtggcaaaagggcatacaccaagctggctgacacttctagaagaagcggaattaaaatcttttgataccgacagcgtaatccgttgtaaacgccaagatttagaaagcgacgaaatcagccaacatttacaagcgggtaaatttgtcacaaaacttgcgttagattgggaaaatcatttttcttttgtgttgaacgaagatgccactcttgcccgtgtcaaatttgccgatgaagtgcgtgaaaagaacgatgatattttgaaagaagacaaagcccaacgtttcgatgcggattttctgttaatgacggaagaattacgtctgtttacagaaaaattgacggaagagtttgggggggtaaattccttgttatctttttagctggtctactatttctcagccaatatttttttatttggaaacttgattgtttttttcgagctagaatggttctattttagaacgattcgctttttttgctgggcgttcttaaagtatgacactcaaacccgatctttttttgaagatcgggttgattattctttagttggcgctgaattataatttaactattctatcattttgtttaatagtagaatgatgaaagattgtggaatagatgttatagagggttatgcaaacatttttttttcgtcattcattgacttgggttatttttgcttttttaggcttttgctttttcccagtaaaagcattgcaatatggactgtttgaagcaacttcagccgaatttcaacaggctatggggtggagtgatattaaccttacttggatatggttttttcccctactgctttatctgtatccgaacaaaacaccttcaacattacgaagtaaatgtgagttattcggggcagttgggctgtttctctttatctttctttccgcaattttagcaaaaatcagcttaggttatgcggtttttttcttaattgttgcgttgattgcgttagcgacaaatgcccttgctgaattaaaaataatgcagggtgacagatttattattgcctcattgattagcattattttgttgatctttttctttatggtctatccaacactggcaattttcatctcaatgttttacgacggcagtgaatttgtaccaagtcaagtgttgtctatcttacaacagccttatgtattaagagtgattggtaattcattaagtgttgcgacaactgttgggattttatctacgttgtttggtttagcctttgctctttataccacacggattgcaaaacgcacggcgtttattggtaaaattttctctatcttacccattgtaacaccgccatttgttgttggtttaggtgtcacccttatgttagggcgttcgggctatgtgactgcttttttagtcgattatcttggctttagtaataactggctttatggttttacagggatagtgattgcccataccctcgcactgaccccaatgtcttttatgattttagacggtgcattaaaatctattcacccatctgttgaggaagccgcttatactttacgatctaacccctatcaagccttcttctatattatttttccgctactcaagccagcgttagccaactcgtttttagttgtggtgatccaatcgcttgcagactttagcacccctttagttttaggtggaagttttgacgttattgccactcaaatctatttctatattgctggttcacagttagattatgcttcggcaagcaccttaggtgtgatcttgttactcttttcccttacgatttttgtggtgcaatatctctggattggcaatcgatcttatatcaccgtatcaggtaaatcttatcgaggtgatgtacaagcattaccaagcggtatgaaatgggcaattatttgcactttaggtttttgggttctgtttaacttcgtactatacggtagtattttttacggtagcttcaccgtaagttggggaatagaccacacactgacattcaataactacctcaatctttttggacaagggtttaatagtggagcgtggccatctttaatccaaacggttatttttgctgctagtgcagcaccgattacggctatttttggtttgttgattgcttatattactgttcgccgtgattttaaagggaaaaagcccttagaatttctgacgttactttgttttgccgtaccaggaacagtgactggggtatcctatattctggcttttaaccatcaacctatttacctgacaggaacagggcttattattattttgtctatggtgatgcggaatatgccagtaggaatgagggcggctattgctggattaagacagttagataaagccttagatgaagcctcgctctcactgaaagctggaacattaaaaaccatctgctttgtcgctttaccgcttttaaaaccggcgttactttctgccttagttactagttttgttagatcaatgacaacagtcagtgcgatcatctttttagttacagcagacacacgcgtcgcaacctcatatattttaaatcgagtagaggatggggaatatggaatggcgattgcctatggctcaatgttgattgtagtcatgatggcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttatttgattggcttgttggcgatacgcatatagcccgttcaaagcaaaaagatgaatttggggaaaaaaatggaacaaaaaaatgattttctcgtgttgaaaaatatcagcaaatcttttggtaaacatagggttatagataacttaaacttttcaattaaacaaggctcaatggtcacgttactcggcccttctggctgtggcaaaaccactgtgttacgtttagttgcaggtttagaaagccctacagcaggacaaatttttattgacggcgaagatgttacccacaacgcaacgcaacagcgagatatttgtatcgtatttcagtcttacgcacttttcccacatatgtcgattggtgaaaatgtggaatatgggctaaaaatgcagggtgtatccaaagaagagcgaaaacagcgagtaaaagaagcattagagttagtcgatctgatagggtttgaagatcgctatgtcgatcaaatttcaggcggacagcaacaacgagtggcattagcaagagcgttaattctcaagcctaaagttctcttatttgatgaacctctaagtagtctagatgcgaatttacgccgttcaatgcgagaaaaaatccgcgagttacaacaacggctcaatatcacttcactctatgttactcacgatcaaagtgaagcttttgcagtgtctgatgaagtgattgtgatggatcagggtagcattatgcaaaaagatacggctaaaaatctctatttacagccaaactctctctttgttgctcattttatgggggaatcaaccattttttcaggaaaacgacaaggcaatcaaattaatatcggtgagtttgcttttacccttgaaaatgcagcacgttttcaagtacctgatggggattgtcttgtcggattacgaccagaaagtatccgcttattaagtgatggaactgcagctcaatattgtgaaattaagcaggctgtctatatgggaaaccattgggaaattaccgcactttggcaagggaaaacattaatgattaaccttaacccagaagattatgatgaatcccaaagaaattgttatatagaaataaaaaataaaggggtgtttttgttgaaagataatgcttaagcatattttgactaaaaatctagcattcattcttaatttctaaaaaaagagttgcacggatttttttatcccctataatgcaccacatcagacgcggggtggagcagcttggtagctcgtcgggctcataacccgaaggtcgtcggttcaaatccggctcccgcaaccagttttaaggctcattgttttggttaagacgatgagttttgttctatctaggcatttgaaattgtaaaatgttagataaaacaaaccgcttgaagcctcaactgttgtagtttgaggcttttttgtggctacatagtcagctttgttgtgttaaagggactttttcaagtcctttttttatatctgtcaaatggaggtttccttggcaacattagaacaaaaattacaagagcttgtcgccgatctcattgatgcaatgggatttgaacttgtcggcgttgagtgccaacgtgcagggcgttttttaactgtacgattatatattgataaagaaggcggtgttacggttgatgattgtagcgatgttagccgtcaagtgagtgcgatttttgatgtggaagatccgattgcggataaatataacctagaagtatcttcccctgggttagatcgtccattatttacattagcccactatcaacgctttgttgggcgtgaaattgttgttcatttacgcattccaatgttagatcgccgtaaatggcaaggtgaattagtgagtgttgaaggtgatttaattaccttaaaagttgatggcaatttgcaggcttttgcctttggcaacattcaaaaagcaaatttaatccccgtttttaatttctaaggaaatcaaaaccaatgagtaaagagattttattagccgcagaagcggtatccaatgaaaaattattaccaaaagatgccatttttgaggcacttgaaaccgcattagccatttcaacgaaaaagaaagcggctgcagaacgtgaagatcgtaaaacgggcaacggcattgatattgatgtgcgtgtagtgattgaccgtaaaacaggggcattcacaacttaccgccgttggttagtggtagaaaaagtgcatcaccacactcgtgaaattaccttagaagcggctcaatttgaagacccgaacattcaattaggtgactatgttgaagatgagattgagtctatcgcattcgaccgtataacaatgcaaaccgctcgccaagtgatcaccacgaaaattcgtgaagcggaacgtaataaagtgattgaacaattccgttcagaagaaggcaaaattgttatcggtactgtaaaaaaagtaagtcgtgaaagtattattcttgagcttgcaggtaaaaaggacgataccactaaagctgaagcagtgattgtgcgtgaagatatgttaccgcgtgaaaacttccgcccaggtgaccgagtgcgtggtgtactttatgcaattaagcccgagtcaaaaggtcctcaactattcgttactcgtgcaaaaccagtgatgttacaagagttattcaaacttgaagtacctgaaatcggtgaagaagtgattgaaatcaaaggggcttctcgtgatccaggctctcgcgccaaaattgccgtgaaaagcaatgataaacgtatcgatccagtaggtgcttgcgtcggtatgcgtggtgcgcgtgtacaggcaattactaacgaacttggcggtgagcgtgtagatatcgtgttgtgggacgacaacccagcacaatttttgattaacgcaatggcacctgctgatgttagctcaatcgttgttgatgaagacaatcactcaatggatattgctgttgaagcaaacgcgcttgcacaagctatcggtcgtaatggtcaaaatgtacgtttagccacccaattaacaggttggacattaaatgtgatgacaaccgatgagttagaaaaaaaacatcaagcagaagacaataaagtgattaatctctttatggacgctttagaaattgatgaagaatttgctcatcttttaattgaagaaggctttacctcattagaagaaattgcttatgtaccagttaaggaactgacagcaattgatggcttagaagatgaagatctagttgaagaacttcaagtgcgtgctaaaaatgcgatcacagctaaagcgttagcggaagaagaagcattaaaacaggcacatattgaagataaattgttaaatcttgaaggtatggatcgccatatcgcctttaaattagcagaaaaacagattaccactcttgaagaccttgcagagcaaagtgttgatgatttagctgatattgaagaattaaccgcagaaaaagtcgcagaattaattatggctgcacgtcaaatttgctggtttagctaaaaacagggagagaaagaatgagtgaaaatgaaatcaaaacagacgcaccgaagaaattaagtttacagcgtcgtactaaaacaaccgtgagcggtacgactgcaggcggtaaagcaaaagaagtgcaagtggaagtgcgtaaatctcgcaaagtggatactgaagcagctaaaaaagcccaagaagaagcactaaaagctaaacaagaagcggaagctaaagtgaaagaagaggctaaaaaagcagaagctgccaaagccgaagaagcaaaaaaagcggtacatcaagtgcctgtaatgccaaataaacaaccaaaaccagcgcaaccgaaagcagaagctcaaccaaaacaagaaaaagcggttgatcctgaaaaagaggcaaaacgtaaagaagaagctgaattgcgtcgtaagcaagaagaagtggctcgccaaaaagcggaaatggacgcaaaacgtgcagcagaaaatgctcgccgtttagcagaaaatgctcgtcgtttagcagaaattgcccgtgaagaagcgattgaaaatggcgaagactatgaagatgaccgctttacttctaaatatgcgttagaagcagaacgtgactctgagcgtcgtagtgaaggcaatcgtggacgtggcaaaggcggtgtagcgaaaaccaaaaaaggcggacgtgatgatgaaaacggcagtaaaaatgaacgtcaatctgaccgccgtaaccaaaaagataccaaaggcaagggtaaacacgcgaagaaaggcagtgcattacaacaagccttcactaagccagctcaagcagttacgcgtgatgtggtgatcggtgaaactattactgtggcagaacttgcgaacaaaatggcagtaaaagcgaccgaaatcatcaaaacaatgatgaaaatgggcgaaatggtgaccattaaccaagtgattgaccaagaaactgcacagcttgttgcagaagaaatgggacacaaagttattctgcgtaaagaaaatgagttagaagaagcgatcttagaagatcgtgacttacacgcagaaaaagtaacccgagcgccagttgtgaccattatgggacacgttgaccacggtaaaacctcattattagactatatccgtaaagcgaaagtagcagcaggtgaagctggtggtattactcagcatatcggtgcatatcacgttgaaaccgacgacggtaagatgattaccttcttagatacaccaggacacgcggcatttacctcaatgcgtgcacgtggtgcgaaagcaacggatatcgttgttcttgtagtagcagctgacgatggcgtaatgccacaaaccattgaagcaatccaacacgcgaaagcagctggtgcgccgattgtggttgcggtaaacaaaattgataaaccagaagcaaacctagagcgtgtagaacaagagttattacaacacgaagtgatttctgagaaattcggtggtgatgttcaatttgttcctgtttcagcgaaaaaaggaatggggattgacgacttacttgaagccattcttcttcaatcggaagtattagaattaagtgcggtaaaagagggtatggcaagcggtgtggttatcgaatcttacctcgataaaggtcgtggcccagttgcaactatccttgttcaatcaggtacgttaaacaaaggcgacatcgtactttgtggctttgaatatggccgtgttcgtgcaatgcgtgatgaaaatggtaaagacattgaatcagctggtccatcaattcctgtggaagtattaggactttcaggcgtaccagccgcaggtgatgaagcgacagtggtgcgtgatgagaaaaaagcgcgtgaagtggcgttataccgtcaaggtaaattccgtgatgtgaaattagctcgccaacaaaaagcgaaacttgaaaatatgtttagcaatatggcggaaggcgatgttgcagaattgaacgtgattgtgaaagcagacgtacaaggctctgtagaagcgattgttcaatctttacacgagctttcaacggcagaagtaaaagtgaaagtggttggctctggcgtaggtggtattacggaaaccgatgcaaccttagcggcagcgtctaacgctattgtacttggctttaacgtccgtgcagatgcctcagcacgtcgcattatcgaaagcgaaaacattgatttacgttattattcaatcatttatgagctattaaacgaaatcaaagcagcaatgagcggtatgttacaacctgaatttaaacaagaaatcatcggcttggcagaagtgcgtgatgtcttccgtcacccgaaattcggtgcaattgcaggttgtatggtcactgaaggtatcgtcaaacgtaacaacccaatccgtgtattacgtgataacgtcgtaatttttgaaggcgagttagaatctctccgtcgtttcaaagacgacgtttcagaagtccgtaacggtatggaatgtggtatcggcgtgaaaaactacaatgatgtaaaagtcggcgaccaaatcgaggtattcgaagtggttgagattaaacgttcgatttaatctattgatattagggcaaatgtcatttgcccctacaaatttaacggcataatgatttctcgttatgccgttatttttttattcttccaacaaaaatttctgttagaataaatgcaaccctattcagcattggaggtaatatggctcaaatttatattcaatcggattactttcatcaacaaatggcgtgtattgtgcaagcaattcaatcaggaatggaaaaacaagcactaatttcttacgttcaaaacgtagaaaaacaaattgccgataaggtggaagagcctgcatttaactacgatctagaaagaatgaaagcacacgttgaaagtgaaactattgaaatgccttcggacttaacaagtgcaaaagcaattaaggagtggttacttaatggctaacttgacaattgaatatggctcactttttcgtaaagaatttgccaattttccagtaaaagaccaagatgcgatcgttgaattcgttgagcatattcaaaattttggctttaccaaccttgaaggcaggaataaatcttccgacaacgtgcataaaaacgatccgcactttgctcaaaaagtaaaatatgcgcgagaaaatcatctatggcattaccacattggtatccttgcctttgatttaagtaaaccttttggcgatagaacgtctgaatatgtgctgcattatcagcgttttagtgatcgagtaaaaatagtcgattattcagctcacccgccttttaatttacccacagcttcttaccttagataaatgacattactggtatcctttaagagtggaaaaagtgtcagtttatgtaaattcaaagtcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgctgaaagtaatgggtacaagcggtgagattaagacttccgcaagcggtgataccatcacattgaaattagatgaaacattgaaaaataaaattaatacgattgacaatttaggttggaannnnnnnnnnnnnnnnnnnnnnnnnnnnnnnnnnnnnnnnnnnnnnncggaacatcttatcaaaatgagcgatacggcaaccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatattacgatttctacgattggtaagttaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgggtccagcaggaccacaaggtgaagctggtccngcaggkccaryaggtcctgcgggtgcagcaggtccagcaggtcctgcgggtccaagaggtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagagcggtcgcatttggtaacagtacattagctggcatacaatcggtggctattggtaacgttgcaattgcttcaggcgaaaaatcgatagctattggtgataatgctaaggctgtgggcaaccaatctatctctatcggtacgggtaacgtagtgaacggcaataactccggtgcatttggtgacccaagtgtgattaatgctgataactcttattctgtgggtaacaataatacgattgagaacgaaaatgtctttgcattgggtaacaagattaccaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcgaggggaagccacgatcagatgttgtgcttgtgcgatccgttttgccacgatagaactatcttcgagcttaccgatacgcaaaacaagatcataaccctcagccacgacatcaacacgacggtcgctaaattccaaattcagttgcagatgtggataggtttcggtaaaacggtgtaaatgtggagcaacaaaacgagagccaaaatccatcggcaacgacattgtgagcttcccttgtagtgttgaggtaatgttcgttacacaggcttcagcgtctttgagttcgtttaaaatgggctggcagcgttgataaaaaagcaaacctgcttccgttgggctgatacggcgtgtggtacgttgtaataagcgaacgttgaggtgttcttctaattgagcaaccagtttactcgccatcgcaagagaaatctgttcttgctgtgccgcttgggtaaaactttgggtttcaatgactttacaaaataggtttattgccttgagtttatccatagatgttagcttgatattgtcttttagggaaatgcttgctattgttacaaaaattttgatgcaattcaattttaatatttacttttaagaaataatttcaatattatttatattattatttaatttaggtattctcaatgggaaaatcattagtaattgtcgagtcgccagctaaagctaaaacaattaataaatatctaggcagtgactttgtggtgaaatcaagtgtcgggcatatccgtgatttaccaacaagcggtgcggaaaaagaggaaaaaaccgaaaaagccaaagcggtttcgactaaaggtatgacggcagaacaaaaagccttagtaaaatcagagaaagaacgtaccgctttagtgaagcgtatgggcgtggatccttatcacgactggaacgcaacttaccaaattttaccaggtaaagaaaaagtggtttcagagctgaaatcccttgctaaaaaagccgatcatatctatctcgccaccgacttggatagagaaggggaggcgattgcgtggcatttgcgcgaggtgattggcggtgagagcgagcgttttagccgtgtggtgttcaatgaaattactaaaaatgcgatcaaacaagcctttgaaaagcctgaacagctcaatatggatagagtaaatgctcaacaaacacgtcgtttcttagatcgtgtggtgggctttatggtgtcgccgttgctctggaaaaaagtggctcgtggcttatcggctgggcgtgtgcagtctgtggcggtgaaattgttggttgagcgtgaacgtgaaatcaaggcgttccagcctgaagagttttgggatattttagccaaaacgtctgcgaaaaaaggcgatctcgctttagaacttgcacagcataaaggcaaaaaattctcagtgaaaaaccaaaaagaagcagaacaagcggtaaaatctttgcaaaattctgcatttatcgtcactgaaattgataaaaagccgacttcatcgagagcaaaagcgccgtttatcacttccaccttacaacaaacggcaagtacccgtttaggctttagcgtgaagaaaacgatgatgttggcacagcgtctgtatgaagcaggctacatcacctatatgcgtaccgactcaactaacttgagccaagatgcactgacgatggctcgtagctatatcgaaaagcaatttggtgagcgttatttgcctgaaaaaccgaatttttatgccagcaaagagaaagcgcaagaggctcacgaagccattcgtccgtctaatgtgatggtgaaaatgcaagatctaagcggtatggaaaaagatgcagaacgcctatatgacttgatttggcgacaattccttgcttgccaaatgactccagcggaatatgactcaactagtttaacggtaacagcaggggattacgaactcaaaaccaaagggcgtgtattacgttttgacggttggacaaaagtactgccaattcaaggcaaaacagcggaagatcaagcgttgccagaagttagtttgaatgaaaccttgaaactgaacgccgttgaacctagccaacactttaccaaaccgccagcacgttatagcgaagcggcgttggtgaaagagttggaaaaacgtgggatcggtcgtccatcaacctatgccgccattatttcgaccattcaagagcgtggctatgtgcgagtagaaaaccgccgtttctatgcagagaaaatgggtgaaatcgtgacagatcgcttaaacgaagcctttagcgatttaatgaactacgattttacggcaaatatggaagatacccttgaccaaattgcgtcgggcaatagcaactggaaagtcgaattaaaccgcttctttgccgatttctcagaaaaattaaccactgcagagcttgatgaactggaaggcggaatgcgttcgaataatctagtggcaacagacattcactgcccgacttgccaacgccaaatggcgatccgcaccgcaagtactggtgtgttcttaggctgtacaggctatgctttgtcacccaaagagcgttgcaaaaccacgatcaacttaattccagaggcggaattgctgaatgtgttagacgaagattcggaaactaatgcattaatgaaacgcaaacgttgcccgaaatgtgatacggcaatggatagctatgtgatcgatccacaacgtaaaattcatatttgcggtaataacccgaactgcgacagctatgtgattgaagaaggttctttcaaaattaaaggctatgacggcccgattgttgaatgtgacaaatgcggttcggatatgcacttaaaacttggacgtttcggcaaatatatgggctgtaccaactgtgacaacactcgcaaaattctcaaaaatggcgaagtcgcccccccacgagaagaaccagtggcattcccagagttaaaatgcgaaaaatcggacgcttattttgtgctacgagatggggcaagcggtgtgtttatgtcggctcacaacttcccgaaatcccgtgaaacacgtgccccgaaagtggcagaattagcgttatatcgtgatcgtttgcctgaaaaactgcaataccttgcagacgcaccacaacaagaccctgaaggtaatgaagccattatccgttttagccgtaaagaaaagcgtcagtatgtgacctctgagaaaaacggcaaggcaaccaaatggattgtggattaccttgatggcaagtgggtagaaagacatagataaaggtagagggctaagtctggtggaatacgatacttagccctttgatttatttttcaataaatagattactttgttgaataagttgtaaaaacagggcgagtggcggacggctagtctgtttttcgccttgtagatcaaaatgttcaaaatcgcctttacggttaatatgaaattgctcaccatttggcattatcgctacattccatttatagtttgaggctagaagccattttcggctattttctttcgttaaatcaataccttgtgcataatcgctaattggcgatgttaccccgaagaactggcttaacagtgttggagctatgtctaaatggctagaaggtaagctataggtgcggttatcaccttgccagtagataagcattggtacttggatccgagcttgtgcaaaactgttgtcgctagtgaccgcttgttcagcaatatcagaggtaatcacaattaaagtactttgggttaagccttgttgttcaagggtttgccaaatatcattgaactgccaatctaaatttttgctttgttgggcatagtctatgcctgaaggaagttgtagatctagatagctaaaaaatgcgttgtcgctacgtttgccgatccagtttttccatttctcaatggcttcaagattgctttttgttttaggtaatttgaaatgggcaaataaggctctgtggtaaatcggttctgcaaagccgttgtgtgaaaatagcccaaattggtagtttagctgttgtaaacgagcgatcagtagcgaaggggctttttcgttcaaaattgcgtctaaatagcgtccacttaatccgtaaaatagtccaacgatgctaccgcttaggctatcactgctgttgtaatgttgggtgaaacggcgagcattttggctgacttggtaaagcgatggcattgtttctgcggtaatcgcttcattttttaagccagagagattaatgaaaagtacattaggcttatgctgtggttcaacaaattgcaaggctttgcgcgggtagttgagataaaaggtgtctaaccgaccgctttcttcgatctgctgttctaatactgcacggtcgataagtccgtgtttttcaaggaaactgcgtgcagtcattgggtaggaaagcggatagtttgctttttgggcggtaatcgggcgatatagggtcatatccgcccacgcatagagtaaatgggtagctgtgaagcaagctagaaacagcattgcaacatattttccccacttctggcggttgaaactacggagcttattccaacaccaacgagagtaaagcatttctgctaataaaatgagtggcattggcacaaaaagcaattgccattggcgtgtcagttcgccgtcgtcgttaggattgactaacagatcccaaacaagcggtgacaaatggaggtaaaaacgcttaaagacttcggtatcaactaataggatcgtcattccgatagtcgcaaatatcactgaaatactacggaaagctcggttatttttaatcagaaagctcagaggaaagagcaacagcagatatagtgcaaagacgacaaagctaaaatgcccaaataagctaataaaaaaatagagcttgccgaaaagggtgtttggccagtcggcattaaaggcatagcgagaggaaatcagcaacgccacaacgatattaaataacgcaaaccagtgaccccaactaatacgttgtgagatctcttctcgatattgccgagaattttcaggaagaaggtggcgaagttgatttaacatattattttgccgattttaatgagttttttaaggcagagctaaatgcctcagcaagcacttcacgttgctgtgggctttgcacgttggtgactaaaatgttcgttaccatattccccaaagccattaacgagagatcgactggggctttgtgtttttcaagggttacaataagatcgtttaatagtgcttcaatttgtttatcttgatattttgatttggttgccattggagttacatcttaaaaaataaaattggtgggaatagtagcataaaagtgatttacaagcggtgagttttacgcaatttttcaatattattttggtttttaagtatggaaaacgtctagcgtttgcaaggggaagtcttatttgggagaactatgttgacgtccctgtccttttgggtatgggggacgtcaaagtgagcgttttagttgttcatatagctctggtataggatttcccagtcttgtgggtaaaaatggatagataatcttcctttctctttattaaacgatcgcaataaccgattcaaattgccttgcttccattcattcccttgctggatttggcatttatcaaaatcaatcagccaaaatattccttgattgtcgatcaaaatattatgaatgttgagatctgagtgatgaacttgatgatcgtgtagcaggcgaatcagttgcccaatctgctgatattgtgctggtgttaagctctttgtttgtagatattggctcagatcttgggtatctgcaattttttctaacaaaatatccgcttgatagaaacaacattgacgtttcactctaattgcaatcggccgaggcactggaatttgccatttagagagctgagcgagcaaacgaaattcttgcattgctcgtgttttttcatggctttgaaaaagatagcgatctttaacgagcttaccaaataagcctccacgataataatgacgaagcacactatttacaccgagttctttttcggtgttgagaaaccaagttgtaccacgcccttttgatgaacctaacaagcggttggattgactgaaatctttgcaatctagtaattgctgcacaaaagattgtttttcatcggcgacaagttgagtattaaaatggtaatacatattttattattctctttttgatgtaattgcgattctacacgatttttgtggattgcgttgtatttttaaggcaatttggtagaatctttcgcttaaatttttagaggatcatcaatgagcaacatctctccagaagcccaaagtgtgcgtgatgcacttcttgcaaaagggattgaaaccccaacggtttgccatcagaaagataaagattctcgtcgtaatgaaatccagcaacatatgcgtgctgtccttgaattattaggtttggatttacgcgacgacagtttagaagaaacgccacatcgtttagcgaaaatgtatatggacgaaatctttagcggtttagattatgaaacctttccaaaaatcacaaaaatcaaaaaccagatgaaagtgagcgagatggttttggtggacgatattaccctaaccagcacctgtgaacatcactttgtaacaattgatggtaaagtggccgtggcgtattacccaaaagattgggttattggattatcaaaaattaaccgtgttgtgcagttttttgcgcaacgtccacaggttcaagaacgttttaccgagcagattttaacggcatttcaaaccattttagaaacggaagatgtggcggtttatgtgaaagcaacccatttctgtgtgaaatgtcgtggtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatactcgcaaagagttcttatcgttaattaacaaataagtgtttggtatagtgcttaattatgtctatggaatataacattactttcctcgatcatcttatgtgatgtgtgattaggtagaggtagtaatgctgaaataattaataggcaagtattatttaaagtaggtacaaatattgtaagttatgaaatttattatcaaacttttccctgaaattatgattaaaagcgattccgtgcgtaaacgctttatcaaaattttaacctccaatatccgtaatgtgttactgcgtgaaacagaaaatgtggcagtaattcgcaactgggattttattgaagtgcgagcaaaagtcgctgaagaagctcctctcgtattgggtttactcaaacgcactcctggtattcatcatattcttgaagtagaagaaatgccgtttaccacaatgcatgacatttttgagcatacccttgcgaaagtaaaaggggaattagagggtaaaaccttctgcgtgcgtgttcgccgtaaaggtaagcacgatttccgctcgcttgatgtggaacgttatgtgggcggcggcttaaatcagcatatcgaatcggcaagtgtgaaattgactaatcctgatgtaacggtgcgtattgatattgaccaggataagatgttgctcatcaaggctcgtcacgaaggtttaggcggttatccgattggtacacaggaagatgtgctatcgctgatttctggcggttttgactcaggcgtatcaagttatatgctaattcgccgtggttctcgtgtgcattattgcttcttcaatcttggcggtgcggcgcacggaatcggtgtgaaacagatggcgtaccatatttggagccgttacagctcgtcccataaagtccgttttgtggcgatcaactttgaaaatgtggtcggtgaaattttagaaaaagtcgataacggacagatgggcgtggtactaaaacgtatgatggtgcgtgctgccagcaaaattgctgaacgttttgatattcaagcaattgtcacgggcgaagcattagggcaagtatcaagccaaaccttgacgaacttacgcttaatcgacaagacttccgatactttagtgttacgtccgttgattacccacgataaagagcaaattatcgcaatggcaaaagagattggcacagatgatattgccaaatctatgccggaattttgtggcgtgatttcaaaaaatccaacagtaaaagcgattgaaagtaaaattatcgaagaagaagggaatttcaactttgacgttctcgaacaagcggtacaaaacgcccattatttagatattcgtgagatcgctcaacagaccgaaaaagaagtagtgtccgttgaaactacttctgaattaggcgaaaacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattaggcgaaaacgatgtgatcttagatattcgtagccctgaagaagtggacgaaaaaccgttcagccttgaaggagttgaagtcaaagagctaccgttctataaactctctaatcatttcggcaacttagatcaatcgaaaacctatctgctctattgccagcgtggtgtgatgagcaaattgcaagctctttatttgaaagagaatggttttagtaatgtaaaagttttcagtatcctctagttattttaattaaggagttaatatgactcaactaagcgttgtgattttagcagcgggtaaaggcactcgtatgtattcagatttaccaaaagttttgcacccgattgcaggaaaaccgatggtaaaacacgtgattgatacagcaaaacagctgtcggcaaaacaaattcacttaatttatggtcacggcggtgatttattacaacaacgcttatctgcagagccagtaaattgggttttacaagcggagcaattaggcacaggacacgcaatgcaacaggctgctccattttttgccgatgatgaaaacattttaatgctttatggcgatgcccctttgattacagcggcaactttagagaaattgattgcggctaaacctgaaaatgggattgcgttattaacagtggtattggataacccaacgggctacggtcgtattatccgtgaaaatggttccgtagttgcgattgtggaacaaaaagatgctaaccctgagcaattaaagatccaagagattaatacaggggtaatggttgcaagtggcgctagtttcaaaaaatggttatcgcaattagataataacaatgctcaaggcgagtattacattactgatgtgattgcaatggcaaatcgtgatggttacaaagttgaagctgttcaagcaacaaatttaatggaagttgaaggggcaaataaccgcttgcaacttgctgctctggagcgttattaccaaaaaacacaagcggaaaaattgttattggctggtgtgacgatcattgatcctgctcgttttgatttgcgaggtacggtaacgcacggtaaagatgtggttattgatgtgaatgtgattttagaaggtgctatccagttaggcaataacgttaaaattggggctggcagtgtgctgaaaaatgttgtgctaggtgataatgttgagattaagccttattctgtcttagaagatagtgtgatcggcgaaagcgctgatgttggcccattcgcacgtttgcgtccaggtacagagctggcagcaaaagctcacgttggtaactttgtggaaatcaaaaaatctaccattggcgaaggttcaaaagtggggcatttaacctatattggcgacagtgaaattggtgcaaatgtgaatattggcgctggcactattacttgtaactatgatggagctaataaatttaaaactatcattggtgataatgtgtttgtcggatctgatactcagttagttgcccctgtgactgtcgcaagcggtgcaaccattggggctggttcaaccattactaaagatgtggcggctgatgaactggttattacccgtgtgccacaacgccatattcaaggttggcaacgtccgacgaagaaataattcattgtactaggaaaatcctcttttggtgtaaaagaggattttttatcaactctgtgccgtaaaactctgcttgcaagatgcagggatatgatgtgtcaagaatctatgctgttttaatcttcattgatatgggcgttgagaatgttgggacatggggtttatagtagtaatcatactattacaattttagtattatatttggtaatatatttcgcacttttccgcaaatgtaataatgctaaaaagccgcagaatattaccgcttgtgagaaatggtgtaggtgttttatgaaaaagtatattaccttatttgttagtttatttttatccataacaggatttgctcagccattatccacaccattagcttatttgactgcaatgaataaagctcatcaaaccttaaattatgaacagctttacatttttcaaaaaggcgatgatgtaacctctttacgctatcgacacgcctatgataacggacaagagtacgctcaactactacatcttgatgccacaagagaagagatgattttaagggaagatgtggttgggtattttggtgattatcagccgttcagtttaaaaacaccccatattttagatgatttcccaaccgttgtttatagtaatttttctcagcttgagggctatgtgtttttagataatgggaaaatgcgtgtggcagatcgtattgcgagggttattcgaattgtgccaagagatgatttccgttatcaatatatgttgtggatcgatgaggaaaatcatctgttgctgcaaagccacttgttggatcgagataataatgtgttagagcaatttaggacaattcaatctgtggtagatgagcagttattgtacattgtagagccaattcgtacattaattctaccaacgttactgcaaactaaagtacattcggaactaaaacctttagaatggcagctaaaatgggtgcctaatggatttaagcaggtggcttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttaagcaggtggcttcaggacaacaaaatttgtctgaggtgttggctcaagatgagcagatcgaaagtcgattatatagtgatggtctgttctcttttacggtatatcttgtgcaaaataaggggatttcatttcaagatcagttttggcgtgagggaaaaaccagtgtttacagccagacaatcggggataaagatgtgattattgtgggcgaaattccgttggcatcggcacgccatattgtgcaagagattgagtttagttcacaaggtgaagaacaatgatgattgaacaagccactgttattcagtatcaaaatggaattgctagagtgcaatgccaagcaaaatctagttgtggcagttgtgtagctcaaagccattgcggttcaaaagccctttctgcattggcgggggaaaaatttgcaccgcaatttgatttagtggttgcaatgcctttgcaagtcggtgataaagtgaaaattgggttagccgagagaagtttgttagaaggtgttttttggttatatgcggtgccattatttgtgattgtgttatcaacattggttttatcgcaatggcttaaccatgaattatgggtggctgctggggtgttgtgtactacggcagtgactttttttatgattaaaagagctattgctcaaaaatctcaggctcagtttattcctgtatttttgggtaaagtttaaaggagatgtaatggaaaaaatttggtttgataattatccagcagaggctgaacgtaccttagatgtggagccttacgagtcgttggtggagatgtttgaaaaggcggtacaacgccaccctgatattcctgcttatattaatatgggccaggtacttacatttcgtaaattggaagagcgtagccgtgcttttgctgcatatttgcaaaatgaattacgccttgagaaaggtgaacgcattgcgttgatgataccgaatttgttgcaatatccgattgcgttgtttggtgcgttgcgtgcagggttagtggtggtgaatgtcaatccgctttatacaccgcgtgaattagagtatcaattgaatgatagtggagctaaagcgattgtcgtcgtgtcaaactttgcggcaaccttagaaaaagtggtgttcaatacgcaggtgaagcacgttattttgacccgtatgggcgatcagctctcttttggtaagcgtacgctggtcaactttgttgtgaagtatgtgaaaaaattggtgcctaaatataaattgccacacgcagtgagttttcgtgaagcgttaagtattgggaaacagcgtcaatatgtaagaccaacgctctataaaaatgatctggcgtttcttcaatatacaggcggaacaacaggagtggctaaaggtgcaatgctaagtcatagcaatgtgattgccaatattcttcaagcaaaatgggtagcctatcctttaatccaacgaagccaagagcagattggggtaattgctctgccgctctatcacgtttttgctttgacagtgaattgtttattatttatcgaactaggtgtaacggggttgttaattactaaccctcgtgatattccagcttttgtgaaagagttgaagaagtatcctgtgatggcgattacaggggtaaatactttgtttaatgcgttactgaataatcctcaactgaaagaagttgatttttctaacttgaagctctctgtaggcggtggtgcagcaattcagcgtgcggtggcggatcgttggcataagacaacggggtgccacattattgaaggttatggtatgaccgaatgttccccattgattgcggcaacacgtaacgattctacggagtattcaggctctattggtgtgccggtaccaaataccgacattcgtattgttgatgatgctggtaatgatttaccgataggtgagcgtggcgagttatgggtaaaaggccctcaagtaatgcaaggttattggcaatgccctgaagataccgcagaagtgctaaaagatggctggatggcaacaggtgatattgttgagctgggacaagacctcaatttacgcattgttgatcgtaaaaaagatatgattattgtatctggttttaatgtgtatcctaatgagatcgaagatgtcgtagcattacatccgaaagtgaatgaagtggttgtggttggtattccaagtgaagtatcgggtgaaagtattaaggtctttgtgactaaaaaagatgaaagcctaactcgtgaggaactgcgtaatcactgtcgccaacatttaacaggctataaaattcctcgagagattgaattccgtgatgagctaccgaaaagcaatgtaggtaagattttacgccgtgtgttgcgagatgaggaagttgctcgagtgaaatcacagatggaaggaaaattgtagtgagaataagtggtatatctgcggttgagatataccactagtcattatattaatctgaattaaggatctcttttgaaattaattaaatattttgctctgattgttttagtgtatgctgttccaacgctgtttacagaaacgatggctggtgatttgtctaaaattcagcagaaaagtcaggcattaaaaaacaaaattgatgagcaaaagaaaaaacgtgatagtttgcaatcgacattaaaaaatcaagaaattgaaatggggaaagtccttaatagtttaaaacaaacagaaatgactttgtctgaaacaagggcatcgattaaacgtacagaacaagagatcaagcggttagaaaaacaggaagcggtacaaaaagagaagcttaaggaacaattggattctgcctatcgttcgggtattcatccttcagtcttagagagattgttatccgaagaagccaaaaatgcagatcgaatgggggcttattatgagcatatcaatcaagtgaggattgatgcgatctatgagttacgtcgcacacaagcggatcttaaagctcgccgagatgagttaaaagagcaacaaaaagggcaacagacgcaacttaataaacagaagaagcaagagaaagatttgcagaaagtcaaaaatgaacgtgaaagtacattgcgttctattgataaaagtttagctcaagatcaaggtcatttagaaaatctgaaagcgaatgaagaggcgttgcgaaatcagttggtacaagcaagcaatgagtctgaacagcaagaaaaacaagatattgcgaaacttgaacagaaaaagaataaggaagaacgtcgtagcgcaacggaatctgaaaaacagcaagttcgggcaggtaatggcttatctgggaaatatcgtatgcctgtttctgggaaaatcatcaatcgctttggctcaacacagatgggtgaaattaaatggaacggcgtggtaattcaagcaagtgcaggcacaccagtcagagcaatagctggtggacgagtgattttagcaacttggttgcaaggttatggggaggtagtcgtgattgaacacggtaaaggcgatatgtcgttgtatggctataatcaatcagtcaatgtgcgtaaaggtgagcgagttcaagcagggcaggtgattgcgagtgtaggaaactctggcggtcaaagtcgttcagctctctattttgaaattcgccgtaaaggtgtggcggtcaatcctttgaaatgggtacagtaaaatgaacaaatggataaacaagcggtctattattttgttgcttttgcaaattttcgggctttttgcaccgcttgcttatgcgaataaattggtgatcgttattgatgatattggctatcgaataaaagaagataatgccatttataccttacccaaagaggtcaatgttgccattattccttctgcaccttatgccacagcccgagcaaataaagcgaaagaacaaggacgagagatcttaatccatttacctatgcaacccaaagtgaaacagcctattgaagctggggcattattggtgggaatgggggaaagcgaggtgagtgagttaattcatcaggctcaacagcaagtaccttacgccattgccttgaataatcatatgggtagtaaagcgactgcggataaaacgacaatgcaacacttgatgaaagccttatcacagcaagggttggggtttttagacagtaaaaccgcaggggatagtgtggcttatcaaacagcaaaagcttatgggttaaatgcattagaacgccacatttttttagataatagtgatgtgtttgctgatgtacaacggcaatttcaacacgccgttcaatatgctcgcaaacacggtattgcgattatgattggacatcctcgtaagcacagtatcgccgtgcttgaactggggattgcaaatttacctgcggatattcagctggcgagtttgagtagtttatggaaaacggaaaatgtcgaaccggttaaaccatttattatgttgtttgagattgaacctgctttaacctctaaagcaccttatcgggcagtaccgttattaagagggatacctcaggaataggtttatgttaatttaagtagaataacacgatgaaaacaagattatctttttgttcgttattagttttaattggtatagcgaatgcagagcaaacagtgttacttgaagttgatgggatcaaagataaagatctctatcaaaatgtgcgtatttacctctcgcagttaagcaacgatgatgcggacagctcagaacgttaccaacagcttgtacaagaaactgtcgataaagccttacgagcaaagggatattacaatactcaatatcgctttgaactaacccctcgtacttcttctaacaaagatctcttaacgctatatgtacaattggatcagccagttaaattagatgagcgtgaaattaagctcacaggacaagccgagcaagacgatgattttaaacggttattagccaaagaggttccgccaatgggaaccgtgcttaatcacgaaacctacgacaattttaaaagcagtatagaaaaactctctcaaacaaacggctattttgatgggcagtggttgtatcaccgtttagaagtccatccgaaggaatatcttgccgattggcgattgggctatgatagtgggaaacgttaccgctatggcaaaatagggtttaaaggcaatcaaattcgagaggaatatctcacgaatatattgcgtattaagtctggtgactattattatttgaacgatttatcgatactatcgaacgatttttcttcaagtagctggttttcatctgttttagttgaaccaagtgtaaagcagccctcaaaagaggtggatttagacatattattaatacctaaaaagaaaaatgatattgaagtggggattggctatgccacagatgttggtcctcgtttgcaatttaactggaaaaagccttggataaacgggcgagggcatagtttagagctaaatagctatttatctaagcctaaacagagagtggagtttggttacaaaatgcctgtaaaagcacagccacttcattactactatcaggtgtcaggtgggcttgatcgagaaaatcaaaacgatacccaatttacaggggcatattctgcttttcagcgtttctggaaccacgaaacaggctgggcgttctccttcggggttaaaacccgttatgatgcttttaggcagggtagtgataaatttaagaccttcttgctctatccaacagcctctctaaatcgcactcgttctgatggcagacgctttcctttatggggggatagccagaaagttaccatcaattttggggataaagctttcatatcagatgtgagtttttacagttttaaggcttcaacggcgtgggtaagaacctattttgataatcatcgtatcgttgcaagagcagaggtcggctatttaaaatcagcggaatttgaacgtattccaccttccttacgttattttgcagggggggatatgagcgtaagaggttttggttacaaaaagatttcccctaaaaataaccaaggtaaactaacagggggatcgcatttagcaacaggttccgttgagtatcagtaccaagtgtacccagattggtgggcagcgaccttttacgatacgggcttatccgataaaaaattcagtagcaaagccctacattcaggggcaggaattggtgtacgttgggcttcgcctatcggggcagttaaatttgacctggcaatgccagtacgctcaccagataataaaaaagggctacaattctacattggcttaggcacagaactttagtgagataatgttatggaaaaagagcaatctttagcacaatcacccaatgatacagcagtaaaaccccacaacacaaaatggcgttggttatggcgtggtttatgtgtgctactgattttgcttttattgcctttagtttttcttgcaacaggaatggggcaaagaaccgctttaacccttgcagataaatggttagatccgctttcgattggcaaagtggagggaagcctacaaaatggcttaacgcttacggatactgcgtatcagctcaacggggtcaatgttcaagttggacaagcggaattacatttagatttgagttgcttattggcatattccgcctgcgtggaaaaaattgcaatcaaagacacacaagtggcggttgataccagcaaacttcccccgtccactccaaatacacaaacaagcggtgagtttaatttgccaattggtgtatcgttaaaacagataagtatagacaatctaaaggttcaagttgatgaacttgatattggcttacagcatttccaatcgggcattcaaggaaaagggaagagcctttcattatccccaactcaattacaaggtttaactgtttcccttgcaccacagcaaactacggaaaagcctcaaaaagtcgctgacgcaccctctcagccaatagattgggaagccttaaaacaacaacttgcacaaccgatcttaaccaaattagatcctattcaattacctgttaatctctctgtgctggaatttcaagcaaaacaattgcagttgagtcagaaagttaagaccgctaaaggtataagcgaaaaatcgctattaaaaatcagtttgcttgagttgcaagcgaaatctgacgaacaatcagtggaattgcaaaaactcaacctgcaaagcgacaaaggcactatttcagggattggcaaactcaccttgtcaggtaattatcctttagattggaaactcaatgctcaaattccacatttaaaagagcttgcaattcctgcaagtcaggcagatctcattttatctggggaactctttggcatcgcaaaattagatctcaaaacaagcggtgcttttgaagcaaatattcacagtactttgcaattttcggaacctaaaacaccgcttgatctcagtattaaaagtccgaaattcagttatccttttatcgcagggaaagataaagatccgcttgtctttgaaaaaatcgacctcgctttaaaaggcgatctactcaattaccacttaaacggtagcttatccgccaaaggtatgaacattcccccagcagatttaaccctaaaagggcagggggaattaacctattttgcagtcaatgaagcattgctcaacgcactacaagggcaaaccaaattcagtggcaaagtcgattggacaaacggcttagaatggcaatccaaccttgccttacagaatgtcaataccaaatccatttttcctgaatgggttgcgttactatcgggggaatttcgttctcaaggctttgttgggcgaggtgaaacaggcaatgaatgggcggttgtactagacaatgtggatttgcacggcaacttacagcaaaagcatttacagttaaaaggcaccttgacagcagatcataacaccttactcaatatccctgaagcaagtttaatttatggcgaaaaccgcattgtaatgcaaggtgttttaggcgaaaaatctgatttcaatgccaccattaaagccccgaatttacaaggtttaatcccacacttaaaagccaatatcaacggacaaattaagctacagggaaatatcaatgaacctagtttagatctcgatcttatcgctaataatgtagcctatgatcaatttcagctacaacatctcaatgccaaagggaaagtaagaaccgcacaacaagtgcaaggtgatctcgaaataggcttgcgtcaattaacttacggcgaaataacgctagagaacgctaatcttacagcaaatggtagtgaagcaaatcatagcctgaaactgaccgctaaaggaaagcctgtgggtatccagcttcagttagcagggaagtttgatcgtagcaaacaacaatggcaaggtgaactaagtaatctcaatatccatacccctgttggcgaatggaaaaatgataaaaatctacaagttagctatcacaatcaagaacttaaagcagatgtttccgcacattgttggcgaaatccaaaagcagcgctctgcttgtcacaaacatttagtgcgggtaaagaggggaaagtgtcgtttgaaatcaaacaatttaaccttgaaatgctacaagaatacttgccgaaagagagtatattaacgggtatcgtcaatgctaaaggtgatgtggcttggtttagccaaaaagatcccgaagttaatgtagagctactttcaaatagccttaaatttacacaaaaactgaacggacgcagtttccctctgtccctttcatcattgaaattaaatggcaaaatcgcagaaaacaatttgagcttggatagcgatattcgcatagaaaataacgggcgtttaaccagcaagctactgatgaaagaacttaccaaacagcgaggactgtctggcaacatcaatatagatcagctaaatttacgtttaatcgaaccgctacttagcacagatgaaaaagttaatggggatattaacgctcgtttaacactgggtggaacagctctatctccacaactgctaggcaatttaaacttaacagggctacaagtgcattctaaatcaatgccatttgatgtaacaggtggaatgcttgccttaaactttaaaggtgcaagttcaaccttaaaaggcaatattcaaacgaaagaaagccaactattacttgaaggcgatgcaaattggcaaaaactagaggcttggcatacacgaataaaagcacaggccaaccgcttccgtgttgatattcctaatatcgccaaagttgatctcagcccacatattgaagtaaaagctacgccaaaagagttaatccttggcggaaatattgatattccttgggcaagaattgccgtagaagaactacctaaaagtgctgtcaccatcagtagcgacgaagtgattatggacggatcagcaaaaaacaagaacaaagctaccgctttactgaataaaaacttgcctcaaaataacaacggaatggcaatcaaagctgatgtcgctattaacattggtaacgacgtaaaattagatgcctatggtcttaaaacagatctaaacggcattatcaaagtccaacaaggaaatcgaggattaggtttatatggacaagttcatttaaaaaacggcacctttgcctcttttggacaagatctcgtaattcgtaaagggcttatatcctttactggattgtcttcccagccaaccctagacattgaagcgatccgcaatccagaagcaatggaagatgctaatgtaactgcaggggttaaagtcacaggaattgctgatgcccccgaagtcaaaatcttctcaaccccgtcaatgtcacaggatcaggcattatcctacattttaactggacgaggattagacggcggtagcgatgcagattcaagcaattccgttgctgccgccttaattggaatgagtttatcaaaaagcagtaaaaccgttggcaccgtgggcagtgcctttggtatcaacgatctcaatgtcactaccgcagggattggagacaacacaaaagtcgtcgtcagtggtagtttaacaccgaaattcaaagtaaaatatggcgtaggacttttcgcccctcttaccgaattaaccttacgctaccgccttgccccaagcctctatttgcaatgggtgtcaagtatcaatcaagcggtagatttgatgtatcggtatgaatttgattagttttttaatggaaattagcacgccaaataaagattgacttttatatagaaaatttataccatcaaaggcgataggattaatatcctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaaacaaaaaggcacggtaagtgcctttttgtgtttataaaggaatatcaatatgaaacaagaacttcaactcaaattgtgcagaattaatcctgaatatacaaaatttttacactctattgatactcgtatttctcccgaaaaagaattggataaaaataaaagacgtatttttgttggcgttgtattaacaattaaccatatttcttattttgctccattatcatcagcccccaatactaaaaataataagaaaccatttgataagcgttttgttattaaaatcacaacgggtttcgataataaaaaaactattgcgggtattaaactaaacaatatgtttcctgttttagatactgttattgaagacatagatcttactaaagaatttgaagaagagcataaatatgcttcattgttgatgaaagaaatgctttttatcaataacccaataaatcaaagaaaaataaaggagaaagcaactaaagtttattcaaaagcaattaataaaaaagataactttgaacaatattgttgtaattttaaattgcttgaagaatattatcagggttttgaaaaatctcagtaatttaattgaaatttcatcatttacgcacatataagtggacactcgtggaaaaacaacgtcaaaaacaattacaaaaatggctacgccaacagcaaaaaattgtaaaaaagtggctttatttaaatgtcttattcggctcattcagtgcaatgttattaatcgcacaaatgggtttactcgccacaatgttacatcagatgattgtcgagcatcgttcgccgacagaatttctgtcacaacttggattattactgacttgctttgcaggcagagcgatattgctttggttaagagagcggactggttttaaagctgggcaaatgttgcgtattcatttgcgtgagcaagtaatggctaagttgtctcacatcggtccaatgtcgatccaacaacgccctgcaggaagctgggcaacgttaatgttagaacaagtagaaaatatccataatttctacgctcgctacttgccacagcaatatctatccttaatcgtaccgcttgctattttggcggctgtttttccgttgaactgggcggctggcttaattctatttgctaccttgccgctgttgccgttgtttatggcgttagctggtattaaagctgccgaagctaatcaaagaaatatcggtattctctctcgtttgagcggacagtttttagatagcttaaaagggctagagacgatccgcctgtttgggcaagccgacaaacagacagagcaaatttaccaacgcaccgaagaatttcgccaaagtacaatggacgtgctgaaaatggcatttctttcttctgcggtattagagttttttaccgccatttctattgcggtaatggcggtctatttcggttttacctatttaggtgaactcaattttggagcttacgatacttctgttaccctctttatcggctttttttgcttgatgttagcccctgaattttatcaaccattgcgtgaattaggggtttattatcacgataaagcagccgcaatcggggcggcggatagcctagagcattttttaagtgaaacggttttagctcaaaccactgggcaaaaaaaagtgccaaaccaaccgcttgaaattcacgcccaagattgtgtaatcctctcgccacagggcaaagcattaacagaaccgctaaatttccaactacaggctcatcaacatattgccttagtggggcaaagtggggcaggaaaaagttcattgatgaatatgttgctaggtttcttatcttatcaaggtagcgtgaaaattaatggcgttgagctaagagaactcgatatggctcaatggcgtgcgactttggcgtgggtaggacaaaatccacagctagtgcgaggctcactacgagaaaatattctattaggtaatgaacacgccaacgaaaccgatttaacaaatgctcttgccttgtcaaaggctgatgaatttgtctatcgtttgggattagatcgagaaatccaagatggcaatatcgggctttcaggcggacaggctcaacgtattgccattgctcgagccttattacgccgatctcaactgctattacttgatgaacctaccgctagccttgatatgcaatcggaacaagaggtgttaagtgcattgcacaatctcagccgagaacaaaccacattgatgattacccatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgatgattacccatcgtattgaagatttaaaagaagctgatgaaatttgggtaatgaaacaagggcaaattatccaacgtggaaactttaccgagcttgccttacaaggttttttgcagaattattaggaaatcaataagctatgcgttcacttttcccttttcttgccctgtataaaactcattttgggcgtttaacattaggtatcattttggctatcaccagtctgactgcgagtatcggcttgctcagtttatcagggtggtttttagcggcgtctgctttagttggttcaagcctgctctttaatttcttttatccatcatcaggggtaagaggacttgctatcggtcgcactatttctcgttattttgaacgcctagtcacgcacgatgccacatttcgtgtactggctaatttacgcattgcggtatttagtaaactcattccccttagccctgcaggattaaatcgttatcgccacagtgagttgcttaaccgccttgttgcagatgttgatacccttgatacactctatctaaacctactttccccttttatcagtgccattatggttattctgtttatggggataggcttgtcttttgtttcgcctctattagcgtgggtaatttgtggcactttagttgcattattactgattttcccgacacttttttaccatttaggcagaaaattaggcaaaatcgcgatacaatccagagctacctaccgctcacagtttatcgagtggatccaacttaacggcgaatttttactatttggtgtattgtcaaaagccacagatagactaaaacagaccgaacagcaatggctcagggcacaaagccacgaaagccagttaggcggtttgtcaaatgccctcttaatgtttattaacggcattttagtcactgccgtgatttacttatcagcgaccgccattaatgtaccacaggcagacaaccccgaagcccttatcgccttagttgtcttttgcgtactggcttcccttgaaatcttaatgccgatcggaatggcattcttacatctaggacaagtgattgaagcggcagaacggatcagcgaaatcaccgcacagcaaccagcggttcaatttaatggcacggctcaatggaaacaaacagaggctaaccaaccgcttattagctttaatcaggtaagtttttcctattcaccagagcacgagcaagtactcaaccacatttcatttgagataaaaaaaggtgaacgcattgccatattaggtaaaacgggtagcggaaaatcaacaattttccaactactcacccgcaattacgatcccacaagcggcgagatcctcttaaatggttgcaatattaaagattaccctgaaaaaacattacgccaacaaattgccgtacttagccaacgcgtccacattttcagcaataccctgcgtgaaaacctacgctttggcaacccacaagccacagacgaagctttatctgaagcgctggcaaaagtcaatttaagctaccttctcgaagaacaaggtttagatttatggttaggcgaaggcgggcgcccactctctggtggcgaacaacgccgattaggattagcacgcctattactcagctctgccgatattctcttacttgatgaagcaacggaaggattagatcgagatacagagcaacagatactaaaacagattttatcccatactaaaggaaaaaccttgctgatgattacccatcgcctaaatgggttggaacaatttgatcgggtttatcggatagcttctgcgattctgaggtaaggatgttaaagttattttgtcctaggtcgatattttgcatggcatagaacaataaactagcgacaatgctactatttcttgtcgctattttaagcatatggaaaaatatcgttagtttttattatttttctaatgagtagctggcttcaaatttcagcctattaatcaatgtattatttgcaggcggaaattgtccttcttctaaatcttgttgagcaatccaaagtccctcttgcccttcccgaccaaaaggttcacctacccactcttccaccaaatagaaaaaaaactcaatcactttagttggatactcgaaactgaaatgttcatacggaaaagcacttaacacataaataccgatttcttcttccaattcgcgacgtagtgcttcctcaggtgtttcaccttgcgacaccttaccgccaggaaattctagcgactgagcaaaatcttgtccttctaagcgttgagttaagtaaatctgcccaaattcattgcggataattccggctgaaacttgaataagaggtttagacataataattccttgtataaaaccaagcggtcagaactgtaaaataatttacttgtctgaccgcttatcaattatgaatatttcgctttgctaccgtgacaatgcttatatttcttacctgaaccacaagggcaaggctcgttgcgtccgatatgaagatcgctgaaatcctgctcttcaccttctgcgtggtagtgagatgactcttgttcagcgtgagcttgtcgttcacgttctgcttgttctacttcttcttggctacgcacttggatacggcttaatacgctgatcacgtttgattttaagtggtcgagcatatcggtaaacattgcaaaggactcttttttatactcttgcttcggatctttttgggcataaccgcgtaagtgaatccctttgcgtaagtagtccattgcagataaatgctctttccaaagttcatcaaggttctgtagcatcacacctttttcaaaactacgcattatttctgctcccaccatcgtttccttcgcttgatactgctctttagcaatgttgatgatacgttcacgcaaggtttcttcgtgtaaatcatcttctgcttcaagccattttacaatcggcagttccataccaaactcttgtttcaagcggttttctaatgctggaacgtcccacatttcttcgatcgattgtggtggaatatactggtcaatgaccgcattaaacacatcttcacgcacagtgttgatcatcactgaaatatcgtccgtttcaagtaagtagttacgttgctcgtaaattgctttacgttgttcgtttgcgacatcatcgtattgtagaagctgtttacgtccgtcaaagttgtatgcttctacttttgcttgagctgaagcaatcactttagtcagcaatttcgattccattgcttcgccttcttcggtaaaggctttacgcatcatattgagcttaccttcattgaggtaaattctcattaaggcatcatctaatgacaggtagaaacgtgatgaaccagggtcaccttgacggcctgaacgaccacgcaactggttgtcgatacggcgagattcgtggcgttctgtaccaataatgtgtaaaccacccgcttgcattacaatgtcgtgacgttcttgccatttagctttgatctcgtcaatttgctcttgggttgggttttctaattttgcaatttcagctttccagttaccgccaagcacaatatccgtaccacgaccagccatattcgtggcaatagtaacagcccctgggtaacctgcgtcagcaacgatttccgcttcttgtgcgtggaatttggcattcaatactttatgcggaatacctgcctgttttagtgcttctgatagcgcttctgatttttcaattgaaattgtaccgactaacacaggctgattacgagccatacagtcctgaatatccttaatcaccgcttggaatttctctggttcgctcttaaacattaaatcggttttatcgtcacggatcatcggacggttagttgggatcaccacagtatccaagccgtagatttgttggaactcaaaggcttcggtgtccgcagttcccgtcataccggctaatttttcatacagacggaagtagttttgataagtgatagaggcaacagtttggttttcgccctgaatatttaccccttcttttgcttcaatcgcttggtgtaaaccatctgaccaacgacgaccagccattgtacgaccagtatgttcgtcaatgatcacaatctcgccatctttcacgatataatcaacattcacttcaaacagtttgtgggcgcgtaatgctgcataaacgtggtgtaataagctaatgcgagctgggtgataaaggctttctccttcgtgcattaagcccattttcgtcaaaatattttcgactttcacttgaccacgctcggtcaagtgggcttgtttgcttttcagatcaagggtgaaatcgccgtcgcctgtgtactcttcggtatcttctttatcttgagcaattaaatgcggaatgactttatcaatcgcttgataaatttgtgtcgcatcttcggctgggcctgaaataatcaacggtgtacgggcttcatcaattaaaatcgagtccacttcgtccactaacgcatagtgtaacggacgttggaagcgctcttctttcgaatgagccaagttatcacgcagatagtcaaagccaagctcactgttcgttgcataagtaatgtccgctaaataggcttgacgtttaacatcggacggtagccctgggatattcaccgcaacggtcattcctaaaaattcaaataacggacggttagtttccgcatcacgacgagctaagtaatcattcaccgtcacaacgtgaacccctttacccgtcaaggcatttaagtaacaaggtaaggttgcagttaaagttttaccttcacccgtacgcatctctgcaatgttacgttcggtcagcaccataccgccgattaactgtacatcgaagtgacgcatacctagcacacgcttactcgcttcacgcacagtggcaaaggcttcgtgtaataagctgtctagcgttgccccttctgctaaacgttgtttaaattcagcggttttcgcttgtaattgttcatcggttaatttttcaaattcagcttctaaacggttaatttgtgcgacacgcttgtttaaacggcgtaaagtacgatcattgctactaccaaaaatagcagtcattaattttgtaaacatatcaattttttccaataaaatataaggtaataagtattagtaacgagtttacgctccccctgcttgcgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggagatagaagaattacgctgttggtccagccctaatcggcggatttgatacttgatacaagcggtatgattttgcaaaaaactcgcaaaaaaccacagcttgtttagttggaataacgagaggttgttgttctaaatgtagtaaatgtgccgcctctaactcaactttttgaattgaagaaaaatcacttaagcgtaatacaagttgatttgtaggcaatgtttcactttcattcgctaacggctgagccgtaggtaacgcaaaaatcgcaacgatccctaataggaattgcgaaatcaatgctggcttatgaaagtgacgtaaaaaattcatttagcactcaataaaaaaataatgttgattatacgacaatttttgtagaataggcagaatataagggcaatctcaccaaaaacaagttaaagcacagcaggaaagatgaaaaattcaacaataaaaaatatcaatgagattttgcagaactctagcttgacgaaaattgtccagcgagccaatgaactcaatgaattaaatcgaaaaattcagcaattactgcccgaacaataccgtggactttaccgaattttgaatttatccgataatttacttagatttgaagtacaaaatggcactgttcgtcaagggctattgttgcagcaaaccgttctattacacttaattcaggcagattttcctgaagtaaccgccttagactttaaggtaaatcctaattttaaatctgcttaacctaagaggatatgactatgaaaaaaattgcatttgccagtattatcgcaatgttaaatgcctgttcgttatggcctcaaaaaagtgtttctggcacttatcaaggcacactaccttgtgcagattgcgaaaaaatcgaagcacaattaattttaaatagtgataaaacctatcaatacaacacggtttattttaagaataaagagcaatatccttttacagaaaaagggagttatgtttgggatcaggataaagatgatgtgcttcatttaagtaatgattttaaatttaaagtccgtgaaaactttgttgagttttgtgatgagaaggggaatgtgttaaaaagttggtataactataaattaaataaagtttctcactaacatacaaaactcagaatatgtttgtctactatgccacttattatgctacctatttatcaattttattaatagttttacataataatcggcattataaaactattatattcatctgatgctctgcaaattgcggataaagttgtgctaaagatttcccactcggcaaaaccaattcaggactgatttcatataacggtacaatcacaaactgtcggttgtgcatatcgtagtgaggaacagttagacgttcgctttgaatttgttcattgccatagagcaaaatatcaagatcgagagtgcgttctccccaacgacgtaaacgaactcgcccttgttcattctcaatgctttgcaacttatcaagtagctcgatagcggtgagatccgtgtcaaattttaccacggcattcacatagtcaggttgatcctgtgggccgagtggtttactgccgtaaaaagagctaacttttagattttttgcaaaggtttgcaacgaaacaaccgcttgcttaagttgagcaagcggatcttctaagttagagccaagagccacataaacggttgtcactattcttccccttttacgattttctttttacggttgaatttacggcgtgggtgacgttttttctttggttcttcgtcacggaaagtgggtaactgtttgactgtttttaacatttccgcacgctgtgcctcattgctaaattggtattcgtgccaccacgcacttaattcaactaaatcaccaccttcaatttcagctcgcatcacgagtaaatcaaagcctgcacggaatttaatatgttcgagagtttgctgtggacgttttcccgtacgttttggaaattggaactgtaatgaccaaatatcacgaataacggtcgtataacgacgatgtaatgcgaccgctttgacactctctgctaaaatttcattggcagccaacatcatcgcatcgtggctgtttaaaccaccttggtttttcaattcgtcaattttctcgcgtagcggataccaaagtagcgctgcaaataaaaaggcaggattaactcgtaaatcgtcacgaatacgttcatcagtggaattgagagccttgctgatcattctttcgctgttgctgtcgccatattcggtaaaaaatgggcttaatacagggaaaagttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaataaaccatatttgcgtaataactcgtaggttttgtgaccgtaacctgattgcagtaatttcaacgactcatcaaataggcgtgcggcaggaatatttttcagtaatactgccattttgcgaataggttcatcactcgctttatctaggaacatatccagttttgccataaagcgaattgcacgcaacattcgtacaggatcttcttgataacgagtaacaggatcgccgatcaaggcgagttttcctgctttcagatcgtctatgccattgaaaaaatcgtagatcaaattatggctaacatcatagtaaaaggcattaacgctaaaatcacgacgctctgcatcttcccgaagtgtgccataaacattatctcgcaacagcattccagcttcgctggttttcgacattttttccgtcgcattgctgtgatgatcggctcggaatgtggcaacttcgtaaatctcacgcccaaagacgatatgggctaagcggaagcgtcgtccgattaagcgacactggcgaccaaagattttttgaatttcttctgggcgagcattggtcgcaatatcaaaatctttggctttttgacctagtaataaatctcgaatacaaccgccaaccatataggcttcatagccatttttttgcagtttattgataatggcaatggcgttacttggaaaatcttttggagaaataccgtaatgccctgcaggttgggtaaattttttatgcagaatatgggacggtacggcttgttgcttatggttcgatttcttcttagatgtgtgtcggtgcggttcagtcaattctcgggctgaacgcattgggcgagcaactttcttcgcttgatctgtttcaacaagcggtgagtttgtatccttttttttacgactaaaaaaagatttgatgtaatttaaaatagatcacctcaattatataaaattgtagggtgggtcttgacccaccgtttcaatttatatgcggaagtggtgggttaaaacccaccctacttaattaaccgcccatctgtttttcacgcagttctgcaagggttttgcaatctacgcaaagttctgccgttgggcgagcttctaaacgttttaagccgatttcaataccacaagtatcgcagtaaccgtagtcaccttcatctaacttgattaaggtttgctcaatacgtttaagcaatttacgttcacggtcacggttgcgtaattcaaggctaaattcttcttcttgcgttgcacggtcagcaggatcagcgaagttagtcacttcatcttgcatttgacttttggtacgttccgcttcctccataatttgtgcgtgccacgcttttaaaattttgcggaaatgctcaatttgagcttcattcatatactcttcgtctttacctaattggtaaggcgacacgcccgcaaggactaataaacttaaagaagtggattttgccactgtcatatttcactcctgtttttggaatttttcttccctaattttaccgctctatttagggtgttttgaaagcgcgtataaataacagaactctctgcatttggcaaattaaatttgcaaaattgagggggaaaacattcagattgtactagttttcctatatagctattgcaatggcaagtatataagaaggttatgatttttcaaaaacaatagagtctaagtttaatttaatattcctctccgtttcgcctcaatcttttctaacaactgcacaatcgtctgattcgcaaaaatctcttgtgtggttttactcaattttctgcgccagtttggatattcggtgcttgttccagggatatttaccggctctagcatatttagccagtcttctggttgtgagccgaatagtacgctgttggtatctgccacatagctttgtagctggtggttaaaggtctgagtaacgcctgcactatccgcttctagcggttgtaccgcttcaacggcacggcggatcgcttctttgtttgtatggcgagtgtttttcagaatgttaagcactttctcattcgggtaaacgccatatttttgccctaactcgaaatcatagcctttccagtagccttgtaccgtcggtaaatcgtgggtacttagggtggtcattgcttgatatggatagttagccaatggtttgcttccttgatggtcgtactcaaaatagaaaatgttgtaggctaaaatacctttttcctctaaggcttctaacattcctttcggtacagttcccaaggcttcggcaatgattaaacattggtggcgttggctttcaagggctaagattgaaagtaaatcttccaacggatatttcacataagcaccgtttttcgccgagtcgcctttcgacacccaccataaacgggcaaagccgagaatgtggtcgatacgcaatgccccacaatctttcatattggcacgcagtaggtcgataaacggctgataaccacgctcttgcaacacttcagggtgcattggcgataagccccagttttgcccttgcggtgccataatatccggtggtgcacccacagatgcccctaacacgaacagatctttatccgcccacgtttccgccccattatctgccacgccaacagctaagtcacggtagaaaccgatcggcataccgagctgttttgccagttcgttacaggctttgagctgttgttgtgccacaaattgcaaccacatatagaaacggactaaatcgctctgttcttgttggaattgttgcaccgcagcggtgtgataatcttgatattttgcgtcccagcagttccagccccattgttcgctgaattgagaagagagccattgatgtagagcatcaaacgtgccttgcactttcaaggcttcgccgttttcagtaataaattgctcaaaagcggtttgatcttgctgtttaaattgctcataggctaagcgtaagccttgcaatttcagccacatcacttgtgaataatcgacataatctttttggcgagcttcgtttaattggcgttgaatatccgccgagttaaaccacgcttgtgcctcactgctttgttggaaagcctcaatcgccccaacgttgatataagcaatgttttgccataaacgagaagatgggctgtaagggcttgccccttcaggattggctgggaataacgaatgaattggatttaacccaacaaaatcaccgcctttttctgctaattttgttaaaaattccgctaaatcaccaaagtcgccgatcccccagttttgttctgaacgtagggtgtagagctgtaaaatcgcgccccatagttttttatgctctgccagttcttgcggttggtaagcacgttcaggggtaacgataatgcgacattctgcggttgtgccgtttagacttaattgatgataaccaaggggtaaatcacgaggcaggtcaatgctattgcgtttgcattttcccgttaaaatctcaccgctttcaagggtcaacgtccagtttgcgtgaacggtttgggttttatccgccacaaaaagcggaataaagacttgctcgccttgtttgacgactttaacaagcggtaggattttgcgactttttggcgaaccgagcaattttgccactttgccataaacggacggttgggcataaacacggcgaccgtgttcgtccacgaagtaacgatttaaaaatgggtgattttgtttcattgttattgtttcccgaatggtattatttnnnnnnnnnnnnnnnnnnnnnnnnnnnnnnnnnnnnnnnnnnnnnnnnnnnnnnnnnnnnnnnnnnnnnnnnnnnnnnnnnnntttaccctttcaccccacctgccgttaatccgccgactaaccaacgctgtgcgatgataaagactaaggtaattggaatggcggataaaatcgctgccgctgcgaaatctccccataggtagttttgtgggtgtagatattgttgcattccgaccgcaagggtgtagttttccacatcacgcaataagagagaggcaacaggcacttcgataattgcagagataaaggcaagaatgaaaactaccgctaaaattggcacagataatggtaataaaatcaaacggaatgtctgccacggggttgcaccgtcaagtgctgcagcttcttcgagcgatttatcaatggtttcaaaatagcctttgatcgtccaaacatgcattgcgataccgccaaggtaagcgaagattacaccaccgtgagtatttaagcccaagaacggcacataagttcctaagcggtcgaataacgcatataacgccacaagtgaaagtaccgctgggaacatttggaaaatcaacatactttgtaacagcattgatttacctgtaaagcgtaagcgtgcaaaagcgtaagctgccgtagtagaaagtgctagggtaataattgccgtgacacctgcgactttaaccgagttccataaccaaagtagcacagggaatggcggtggggtaacagtgccgtccgcattggtgacgctaaaaccgagtgccagtttccagtgttcaagggaaatttggcttgggataatttcccctaatgccaagttacctgggcgaagtgagatccctaaaatcatcagtaaagggaacataatcaatgcacagaacacaataagaaagaaatgtgttgcaaataagcgtgctttcattgatttaggttgaacgatagccattttatcccccttaatcctgttgtaatttagtcaaacgaatttggaacaacgctaatccgctgacgagtaagaagatgattactgcgattgccgccgctaaaccgaagtcttgcgtaccgctaccttcaaaggcgatacggtaggtgtagctcactaacaagtcggtatgtcctgccggtgtgctggttccgatcattgacggacgaccttgggttaataattggattaacacgaagttattgaagttgaaggcaaaacttgcaatcatcaatggcattaacggcttaattaacaacggcattgtgattttggtgaagttttgccataccgatgcaccatcaatcgctgaggcttcatataaatcnnnnnnnnnngctttgagtaaacccatacaaacaatcatcatataaggataacctaaccaagtattcacaattaacaacatcactttagcaaggaatggatcgttaaaccactctgggcgaatgccgaataagttatttaaaattaagttgatctcaccgaaactttggttaaataaacctttaaatacaaggatagagataaatcccggtaccgcataaggtaaaattaacagtaaacgataaacggctttaccttttaacgcttcccattgtactagagaggcgaaaatcataccgagtaatgtggtaaacacgacagttaagaatgcaaaggtaactgtccaaataaagatttgaataaagggtttttgtacaccttcgtccgttaagattttcacgaagttttgccagccaattgctactgtataacctggttcaacacgtttacctgtaaagttaccttgctcatcaatttgctcaaagaaaccgacatcatcattgggtttataacgttcattggtttcgtggttggttaaaatttggctctctgcatcaaagctaaagcggtagctttgttgagaaaattgacgaagtgaactcatcgtgagcatttcttcgcttggtaaaatcgcattcaccgtttgaagttgttggcgattttgggtaatggttttaaacggtgcaactttgctttctggcaatgttgccacttcttctaatttgatttccccttttaaatcggctagtgcaagcggtgcagaaaggtaagttttttgcacatttttattttcaagggcaagctgatattgattatccgctgtttcaagtaatttgaaatcgtaacgttcgcccgaaaaatagcgttggctttgcaattgattaactacacgttcaaaggcgagctggtttgaaccgctgtaattagtaaaagcgataacaacagtacagacaagtggaaagactacaaatatgccgattgcggatatgcctgggaacagataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccagcgataagcccgttctgaactaaacacaaaaatacctgaagccactacgactaaggttagtaatgcaaataaaatttcaccttgcagataaattgtaaaaaccaagtaaaaagcaagtaggtaaagtaatccgacaaaagccctcttgctccaaagttgagcagacgaaatcgaggaatgagttgaagttagcattttaattttccttgttttagtactgcgaagaggaaattgcaaaaaatgagaagaatgtgaccgcttgatactcgtagggacacactgcgtgtgtccgccagtctgcttgtgtccgtctaatttggattatttaacggacacacgcagtgtgtccctacattttttatttattaaaaattactctttttcaatcttcgcttgtgcttcatctaatgcggctttaacagattggcgaccgttgattgcactgtcaatcgctgctttttctgaataccagaaacggctcatttgaggaatgtttggcataatttcaccattttccgcatttgccattgttgcagcaatacgcggatctgctgctaattttgcttggtagctcttaagtgctactgcacctaacggagtatctttattcacggtttctaaaccagcatcagttaataagtggttttctaagaactctttcgctaagtcttggttcggacttgaggcatttaccgcagcacttaatacgccaacgaacggtttacctgctttgccgtttaaggttggtaataccgctacaccatagttaataccgcttttctcaatgtttgcccaagaccacggaccattgatagtcattgccgtttcgcctttattgaaagaagcttcagccacagagtagtcagtgtctgcgttaatcacttttttcttcactaaatcaaccacaaattgtaagcctttttgtgcagcttcattatttacaccgatgtcttttgcatcatagccgtttgcggtcactttaaacgcataagcaccttgagaagagatgattggccaagtgaaatagggttctgctaagttccacataatcgcatttttgcctttcgctttgagatctttatctaatttctccacttcttcccaagtttttggcggatttggtactaaatctttattataaatcaatgagagcgactcaacggcaatcgggtaagcgatctgtttaccattatattttgtagcttcccaaccgatatcagataattttgctttgaattctgcacttgggtgaacttctgctaataagcctgattgagcatagccaccaaaacggtcgtgagcaaagatcacaatatcaggaccatcaccagttgccgcaacctgtgggaataattcttctaatttgcttgggtgttcaacaacaacttttacccctgtttctgcttcaaattttttacccacttctgctaagccgttataacctttatcggcattgatccagatgttgagttgtccttcaactaattttgcatttacaccttgtgcgatacataatcctactaataccgctaatgctgctttggttaattttttcattgtttttccctcagtttagtgaaatgaaattttgacagtcgaatagtggaggatttcttctcatacttcatcatacccccttatcatccccccttatccttttagtgatctgtatcacatttttgattgtttttaaaataagtgtgaaagagatcacaaaaaaagcgtatgaatttgtgatctaagtcacaaaaaatctgcttttctgcgaaaaaattttttacaaggtagtgaaaaattttttcacaaagtatgatttcaagacaagaggaaataagtaatcttggcacccgtcaaaaagtagtaaccctaaggcaaaggataagacaatggcagatgtaaaaattattggtgtaaataaatcatacggcgatgtgcatatctcacgcaatattaaccttgatattaaagaaggggaatttgtcgtatttgtaggcccatctggctgtggtaaatccaccctattgcgtatgattgcaggcttggaagatattacatcaggcgatctctttattggtgatacccgaatgaatgatgtgccacctgctcaacgtaatatcggaatggttttccagtcttacgcactttatccacatctgaatgtggctgaaaatatgtccttcggcttaaaactggcaggtaaagcgaaagcagaaattgagcaacgagtaaatcaagtcgcagaaattctccaacttgctcacttactacaacgtaaaccgaaggaactctccggcggtcagcgtcagcgtgttgcgattggtcgtacgcttgtttctcaacctgaagtgtttttattagacgaaccgctctcaaaccttgatgcagcccttcgtgtacaaatgcgtgtggaaatttccaaactgcataaaaaattaggtagaacaatgatttatgtcacccacgaccaagtggaagcaatgacccttgccgataaaatcgtggtgttacaagcgctcggaaacaatacacaaattaccactaacgttgctcaagttggtaaaccattagaactttatcactacccagccaaccgctttgttgctggctttatcggttcaccaaaaatgaacttcttacctgtaaaagtgattgatgtaagagaaggtggggtaaaaattgaattacctgactccacccatctcaacttctggatcccagtagataacacaggtgtgaatatcggcgacaatatctctttaggtattcgtccagagcatttactaccttgtgatcagagtgaagtgtgcattaaaggaacagtaaaagtagtggaacaacttggaaacgaaacccaaatttaccttgaaatgccaccaatcaaacaaagccttgtttatcgccaaaacgacatcgtattagttgaagaaggtgatgaaatgtcaattggtatcaacccaaaccgttgccacttatttaaagaagatggcatagcttgcagacggttgtttaaagagttgggtgtttgagattatctggagagtaaatcaaattaataggttattttaaaaataggtaggcataattgtatatgtgaacaatcatcctaattttttaaggagactgattttatattgataaggaaagctttgtgatatcttaggtgttatactagtactatatgtaagaatttttatttggattttatgtactggaagatatggtgaatttaatgcagccccccttaagcctatacatccatatcccttggtgtgtacaaaaatgcccctattgtgatttcaattcccacgcacaaaagggcattattcctgagcaagaatatattcagcatttgctcaatgatcttgagcaagatctcataagctataaaacagcaatcgctgatcgcaagatccactcaatttttattggtggcggtacgcctagtcttttttccgctgaaggtattcattatttacttgcagaaattcgcaagcggatagatttttctcacgaatgcgaaattaccctagaggctaatccggggactgctgaggcagaacgttttatcgggtatgtacaaggtggcgtgaaccgtatttcaatgggtattcaaagttttgaaccagagaaattattgaaattagggcgtattcacgatagcaatgaagcaaaacaagcggttagatttgctcaacattcagcaagagtaggcttgagaagtttcaacatagatttaatgcacgggttgccaaatcaatctgttgctcaggctcttgatgatttacggcaaggtattgcgttaaatccaccacatctttcgtggtatcaattgacgattgagccgaatacgatgttttactatcgacagcccacattacctgacgatgatgagctttgggatatttttgaacaagggcatcagcttttaactgacgcaggctatgaacagtatgaaacctcggcgtatgccaaaaagggttatcaatgtcagcataatttgaattattggcgatttggtgattacttagcgattggttgtggggctcacgggaaaataagttatccaacaggggaaatttaccgctttagcaaaacgaagcacccgaaaggctatatgcgaggagagtatcgttatcatcaagagatgattgaaaatgatgatcgcccttttgaattttttatgaaccgttttcgcttacttgaagcaaccccaaaaacagaatttgaggcatatacgggactagatcggaaaaaggttcaagccacaatggactgggcattgagcagaaatttcatttcggaaagcaatgaatattggcagattactcagcacggcaaattatttttaaatgaattgttggaaggttttttaaaggaatagaatgcaaaatccctcttatttaaaataagagggatctttatcaaaaaatatttgtttctaaatgaatatgtcctttttcaacaataatatgttttccaaatttttttacaagggattcttttgttctgcgttcatctaatgtataaacagggtggctatttaagatatttgtaagaccatcagcaattattggtaaaaacacctgaagttcattttgatatttttcaggggtagcgttccaattttttaaacgaacattttttagaaatagtgcacctttttccatatcatagaaaggaagagtatccatatttatattaagtttaacttgatattctttaccctttatctgtaatagactgtcgatgatgcctgaaatatcaacaaccttttcatctgtttgtcccacctttgtatataaatcagataatttatagtctagttgaaatagtcctggtacacctaaactatcttgcaaaggcactttttctgctaaacgcgtagccaaatattgattgatttcttgctctgaaatactcaacggactcgcttgagtagtcataggaaaaattatcaacaagagtaagctcagtttatgtaaaagtttcataaaatctcctttggaattggtttaaagtgttaaaacagagtagaatgcgcatcttttgaaactgaaagtttataatagtttttaatacaaagggataaatatgaaaaaaatattcgtgattgcctctattttaatgctcgcaggttgtacttttggtggaagtgtaaatgctggtggtggttctaatggggtcggtattggcttaggaatcggtacgggtatccgtttctaagaactttttatggctttgctgtcaaatagacacttttctataaatatttaaagggaaatcaatgaaaaatttgttaaaaaaatcgttgctaggtttagcatttctctcattaaatggctttgcttttgctgatgctcaagctgtcgcagagttacaacaacgtttagataaagcaatgcaatacagtgcggattttgagcagactgtccgttcaagcaaaggaaaggaaattcaaaaagggcaaggtaagtttcaagtcaaacgcccgaacttatttcgtatggacacccaaagtcctcaagaaaatttaattgtatctgatggcaaaactttgtggttttacgatccttttgtatctcaggtaacggcaaattgggttaaagatgctgtgagcaacacaccatttgtacttttaacaagcaatgataaaagccattgggatcaatatgatgtcacacaaaatgtagataattttgtattaaaaccaaaatcgaaaaaaagtgcgatcaaacaatttgatattcgtattgatgcaactggcttagtcaaaggttttagcactattgaacgtgacggacaaagtaatctctatgtattacgcaacatttcaacggctcatttatctgaaagtctgtttagttttagtatgccaaaaggggctgaattagacgatcaacgtggtaaaaaataagcataacaaagagtaaagcggtaagatttgcagatcttaccgtactattgtactaacaggataagtaagtatgagaaccctttatcaacaacgtgatccaaaagaatggcaacaatttgttgaccttttaaaacaagcggtagcagaagataaaacagatgcattattgtcgatgttattgacaacagacgaacgaacttcgttgggattgcgagtgcaaattgtacgcgcattactcgaaaatcaaatttctcagcgtgaaatccaacagcaattgaatactagtgcggcgactattacacggggttcaaatatgttaaaaactgttgagccagatattttaaagtggatagatacaaaactgaatggcaccaaaacctaagcaaaaacccttgctacaatctattttccgcttttttattcccaaacagatgctatctttaaaaagttggttttggtttggcgttagtcgtattggtgtggcagtcacaactttctatgtttctttaacattgatattttcagtaattcccgtgcctttttcagcttatatgctacagaaaaaaatggaacacctaatacaaggggacttatataaaattcaatatcagtgggttagtcttgatcgtatttcgtggcaaatgcaaatgtcggttattgctggggaagatcaaaaatttccaattcattttgggattgattttgatgcgattgaagcagcaattaagcgaaatagtaaatctcaaaagaaacctcgcggtgcttccactatttctcagcaaacggtaaagaacctttacttatggcacggaacaagttggctaagaaaagggatcgaagtgcctttgacctttttagtggaattgctttggaataaacagcgagtgttagaagtctatcttaatattgctgaatttggtgatggtatctttggtgtagaagcggcagctaaacattattttaagaaatcagcaagccagcttagtttacaagaggcttccttgttggctgcctctttgccaaatccgatgatttatcgggttaaaatgccaagccaaacaatgcgatctcggcaacaatggattatgcgacaggtcaataatctcggcggaataaattatttagaaaaattgtagctattagccttgacattcagggctattttgnnnnnnnnnnnnnnnnnnnnnnnnnnnnnnnnnntacaattaaaaaccattttacaagcggtgaattaatcgcagatttttgacagattttattttttattatagaggttcactatgtctaaatttcaaattcatactatcgacactgcacctgaagcagcaaaagaaacgttacaagcggttaaaaacaataacggctttattcctaacttaatcggcgtattagccaatgcacctaccgccttagaaacctatcgcaccgtcggggcaattaaccaacgtaacagcttaacgccaacagagagagaagtcgtacaaattaccgtagcggtcgcaaatggttgtggtttctgcgtagcagggcataccgcaatttccattaaacagatcaaaatgcctgacgaattgctgcaagcattacgcaaagctacgccaattcaagataacaaattagatacccttgcacgctttacactcgctgttatcaaaactaaaggcaaagtgggtgaaaccctactcaatgaattttttgccgtaggttacacccaacaaaatgctctagatgtggtacttggtgtcagcctagccagcttatgtaactatgcaaacaacctcgcagatacaccaattaaccctgagttacagccttacgcataatgaatgctaaaaaattattaatgctctgccgtgagcctcgtttatatggttgtcaaagacttaaacaagcggcagaacataaaggctaccaactggatattctcgatccaaaccgcttcttgctacaactgcagcaagggcggtttgagctttattatcaaacaggggaaagctacgataaaactcgagcaaaacccgaaaaaatcggggaatatgcaggtatcttgcctcgatttggtacaactagcacagaaataggctgtaatgtattacggcattttgaacaaaaacatgtacctgttttaaatgcgtcttctgcctttgctcttgcccgtgacaaatggcaaagcctacagcgacttgccgcctgtggcattccagtacctgatacgctattaatgggagagctttacagcgttgctgaaggtttaagtcaatcaggcttgccagcggttattaaaacgctgtcaggctctcaaggtgtaggggtaatgttggcagaaaaccacagcggtgccttgagtttacttgaaacattaaaaagtgccaaagtaccaagcctcttacaaacctttattgcagaggctaaagggcaagatattcgagcttttgtgattggcgatcaagttgttgcaacaatggaacgcactggtgcaagcggtgagtttagagccaatattcacagaggtggcaccgcccaagccattcaactgtctgatgcagaacaaaaaatcgcagttcaagcagcaaaagccatcggcttagatgtggcaggtgtcgatcttattcgttctcaacaaggcattatggtgttagaagtcaatgcaagccctgggcttgaaatgattgaacaggtgactaaagtggatattgcaggtttaatgatccaatatttattgagataatttagttaatagcccataagcggcgagatctgtaataaattgtacaaatctcaccgcttgtcttttccattctgctctgattaaggtacaataacgcctatttttatgtttaaataatatcgcctatgcaacacgaattagcacaaacgatcccagaactgattttatggacaaaagagcgagaattttcgctttccctttcttccgaccgcttggcatttttattggcgatagccctgtataataacgaacgcactgacggtgaattgcttgaaagcgatttacaagatattttccgtcatgtttcaaatgcctttgagcagtctgaagcaacacaaacacagcgcgcgaataatgcgatcaacgatcttgtcaaacaacgttttttaaaccgtttttcgagcgaatttaccgaaggtttggcaatttatcgcttaacaccacttggtgttggcgtatcagagtattacattcgccaacgtgaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattcgccaacgtgaattttcgactttacgtctatcgatccaactttctattgttgccgatgaaattcagcgcgcctctaatgcagcagaagaaggtggtgatgaacgtttctggcgtaatcaagtgtttgccccattaaaattctctgtagcagaaatttttgacagtatcgatctttcccagcgtatgatggacgaaaatcagcagcagatccgtgagcgtattgctgcactgttaagccaaaattggcacgaagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggcacgaagccattgcgacttgtcagcagttgttagacgaaacttcggggaatttgcgtgagctacaagatgtattaaatgcgtcaggggataagttgcaatcccaattattgcgtattcaaagttgcttgattgggcgtgatgatttggattttgtcgatcagctgattgtgaacttgcagaataaacttgaccgcattatcagttggggacaacaggcgatcgatctctggatcggctatgaccgccacgtccataaatttatccgtaccgccattgatatggataaaaatcgtgtctttgggcaacgtttacgccagtctattcaagattattttgaaagcccgtggcaactttatattgccaaagcagagcctttgatggatctgcgtgatgatgaaaccgaattaaatgaagcggaagccgtaggcgagctaccgactgagctagaatatgagtccctcacccaagtgcaggagcagattattgcagcaatgcaagaatatcttgtcccattccgtgaacaaggcaaaccgattgatctcggtgcgattttgcgtgaacagttggcaatgtatccgctttctcgccattttgatgtagcaagaattatcgtcgatcaagccgttaaactcggtatggcaagccaagacagccaagcgatttacccagaatggcagtcgattaatgataaaggcgcagaagtacaggcgaatgtgattgaccaatacaataaataacaagcggtcagttttaattaaagttttacaaaaatagagaacgacaatgacaaacacccaagaacttatctcaaccaaattggctgaagcgattgctaacccgatttttccgcaacttgacagtcaattaagagcagggcgacatattagtttagaagcccttgatgaacacgcttttttgatggattaccaaagcgagcttgaacagttttaccgccgttatcacgtcgaacttattcgtgcaccagaaggctttttctatcttcgacctaaagcaacaactttgattgctcgttcggcgatgtctgaaatggaaatgttggtaggaaaagtgttgtgttatctctatctcagtccagaacgccttgcacagcaagggattttccactatgacgaagtgtacgatgagttgcttaatttggcggacgaaatcaagttgcttaaagcaatcaatccacgttcaacaggatcagatttagacaaagcgaagctggctgagaaagtaggtggggcattacgccgtttaggtcgtttaggagtgattactcgtgttggcgatcaaaacagcaaaaaatttgtgatttcagagtcagtgttccgttttggggctgatgtgagaacaggggacgatcctcgtgaagctcaacgtcgtttaatccgtgatggtgaggcaacaaagcctacgattgcgaaagagcaagcggtcagttttgacgaagaatttgcaaatgaagaaatagatgatggtgaagaatagtgaggatatattaattgtaatggaacatgagaaagtagaagaaccctcaatacaatacaacttatttaaagaagcatttccttcatattctgaatttacatttattgacttgtttgcaggaattggtgggtttaggcttgctatggagaagctaggtggttattgtgttttttctagtgaaattgatgaaaatgcacaaaaaacatacgcaactaattttggtgaaaaaccatacggcgatattactttagaagaaacgaaacgccttataccaacaacctttgacattctatgtgcaggatttccttgccaagctttttctattgcgggaaaaagaggggggtttgaagatacaagaggaacattattttttgaagtagctgaaattattcgcagacatcagcctaaagcattttttcttgaaaatgtaaagggattgagtagccacgataaaggaagaacactaagcacaattttaaatgtgttacgagaagatctaaattattttgtaccagatcctaaaatacttaatgcaaaagattttggtgtaccacagaatcgagaaagaatttttattgttgggtttagacaagaccttgcgataaactctttttattatcctgcaccattaaataggaaagtttgttttaatgatgtgaaagaaaaaaatgttgtaccaacgaaatattatttatcaacacaatatattgaaactttaagaaagcacaaagctcgccaccaagataaaggcaatggttttgggtatgagattattcctgatgatggtattgcaaatgcgatcgttgttggtggtatggggcgtgagagaaatttggtaatagatcatcgaatcactgactttacaccaactacgaagataaaaggtaatgtgaatagggaaggtattagaaaaatgacacctagagaatgggctagattacaagggtttcctgatagttatattatccctgtcacagatacacaagcatacaagcaatttggaaattcagttgcaatacctgcagtgcaagcaacggcagagaaaattttggagcatttaagactagaataaagataatatggcgaaaggaacaaaagtaaccgatatagtaaaattaatggttcataaatatccgataaatcaaaaatggaagccaaatgaattgatttctttttattggaatgtgtacacatcggaatttgaatctaacaattcagttaatggtggtgtatttgaacagttacttgtgctagctctgttaagagagaaaatatcacctgtatatgttcaagcagaattagcatttgttccgaatgttattttggatattgtgttatataaccgtaagacccctattactattagtgcaaaaacaactcttagagagcgttggaagcaagcagatttagaagctatggcgactaaatatgtgcatcgagaagcattgtgttatgttgttaccttatctgaaaatgaggtgcttgctcgacgtaaagaagaaaatagttacatggggataaatgattttgttctagctcatacagatgaatttaaccagttagttgaaaaattgaaacaaattcaaattacagaaagtgaaagcataaaaatcattcaaagtgatcataaattctatgataaagacagtgttgagaagctgtatcaaattgaaatttagtatttaggcaaatatatgacagaaaaaaacgacttatttgaacaaaacgtcacttctcaaaatatcatggttgcggcacatgtacaatcgtctatacctagtgtgagccgtggcaaattccgttccctaaccttaattaactggaacggtttttttgctcgaacctttgacttggacgaactagtaacgaccctttcgggcggtaacggggcgggtaaatcgaccacgatggctgggtttgtgacggcgttaattcctgatcttaccttgcttaacttccgtaataccaccgaagcaggttcgacttctagttctcgtgataaagggttgtacggtaaattgaaagcaggcgtttgttatgcggtgttggaaagcgaaaattcccgtgggcaacgtgtgattagtggtgtgcgtttacagcagatcgcagggcgtgataagaaagtcgatattcgttcgttttcattacaaaatatcaatgaaaatcaatcggttatctctgttttaactgagcaggttggtgagaaaaatgcacgagtgctggcgttaaatgatctaaaagagaaatttgatggcagtgaggtgcaatttaaacagtaccattcgattaccgattatcatagttttctctttgatcttggcgttattccaaaacgtttacgcacatcgggcgaccgtagcaagttctataagttgatcgaggcttccctttacggcggtatttctagcgttattactaaatctttgcgtgattatctcttacctgaaaatacaggggttcgccaagcctttcaggatatggagtcggcactgcgtgaaaaccgtatgacccttgaagcaatcaaggttacgcaatcagatcgggatatgttcaaaaaactgattaccgagtccactaattatgtgtcggcagactatatgcgacacgccaacgaacgtcgtggcaatgtacaacaggcaattgaaaagcgtcaagagtggtatcagtctaaatctaaattaacccttgaacagcaacgtttggttgagtttagccgtgaaatgcaggatttggaagagggcgaaagtagccttgaagctgagtacaatagtgcttccgatcatctcaatttagtgatgaatgcagttcgccatcaagaaaaagtggaacgttatcaagatgatgttgcagagctaaacgaacgcctagaagaacaacaaatggcgttggaagaagtggcggaacgtcaagagatggctcaagctcgtgcgacggaagccgaagatcaggttgaagagttgcgttctcaaatggcggattatcaacaggcgttggacgcacagcaaacccgtgcattgcaatatcagcaagcggtgaatgcgttagaaaaagccaaacagatcagcggactggctaatttagatttgcacaatgtcgaagattatcacgctgagtttgtggctcaagccgacgaaattaccgataaagtgtttgaacttgaacagcgtttatcggtgtccgatatggcgaaaagtcagtttgacaaagcctatgaactcgtttgcaaaattgcaggggaaactgaccgcttacaagcagacagcgttgcccgtgaattgctgagtgcgtatccaagccaaaaagcccacgcacaacaagcggtggctttgcgtcaaaaattaacagaattagaacagcgtttacatcaacaacagaacgcagaacgtttgcttgccgagtttaatcaaaaagcacaagcagagttggaaaacgcagaagatcttgaaagctattatgaagagcaacaagctcgccttgaagatttggaagcggaactcgctgagtttgttgaagtacgttcaacacaacgccagcaacgtgagcaattaaatcaacaatatcaacaacttgcacaaaccgcaccggcgtggcatacggcacaatcggcattagcccgcttgcaagagcagtgtggcgaaacctttgacagtagccaagcggttatgcagtttatgcaaaataccttaagccgtgaacgtgaagcaacccttgaacgtgatgaacttgctcgccgtgaacagttattagatgagcaaatttcacgcctaagccagcctgacggcgcggaagatattcgcttaaatcagctggcggaaaaatttggcggtgtgctgatttcagagttatatgaagatgtgtcgattgaagatgcaccttatttctccgcactctatggcgatgctcgccacgctattgtggtgcgtgatttggaagcggttaaagcacaattacagcaacttgatgattgtcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctatttgatcgaaggtgatccgaatgcctttgacgataatgtctttaaatcggaagaactgggcgatggcgtggtggtgcaactgtctgaccgtcaatggcgttactctaagttctctgaatttgcggtctttggccgtgcttctcgtgagaaacagcttgaaaaagtgaaagctgaacgtgatgaaacaacggaaaaacacgcagaacgtgcctttgacgtgcagaaatgccaacgtttacaccaacatttgagtcagtttgtcgggacgcatttagctttagctttccagcctgatcctgaagtggcaatgcaagagattgcacaaaaacgggctgaaattgagcgtgaactcaatcaagcaagcggtacggaacagcaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcggtacggaacagcaattacgtcaccaacttgaaaacagcaaagcccagttgcaactgctgaataaagtgttgccacaactcaatattcttgccgatgaaaccttacaagatcgtgtggaagagtgtcgtgaacagctactagaagcacaggaagacgaacaatttatccgtcaattcggcaatgcgttagcacaacttgagccgattgcagtggcgttaaagagcgatccgacccagtttgaacagctacaagcggattacaagcggtctgttgagcaacaaaaattgcaacaacagaaagtctttgcccttgctgatgtgatgaaccgccgtttgcacttcagctatcaagaaacagtaggggcggaaggttctgctcttaacgaacagcttcgccaacgtttagacaatgcacaacgtgagcgtgagcaggctcgtgaacagcttcgccaagcgacagcacaatttagcgaatataaccaagttttaacgtcgttacgcagtgcctttgatgcgaaaaatcagatgcttcaagaattgttgcaagagatggacgaatacggtatccgcaatgatgatggggcagaagagcgtgcgagaatacgccgtgatgaattgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcgtaaatcttatattgataagcaagtggcggttattcaagcggaaatggataatcttaataaagcggtacgtaaagcagagcgtgattaccatactcaacgtgaaattgtggtacaggcaaaagtgagctggtgtttggtgctgaaactctctcgtaatagcgatgtagaaaaacgcttaaatcgtcgtgagcttgcttatcaatcggcagaagagttgcgttcgatttccgataaagcccttggtgcgttgcgaaccgcagtggcggataacgaatacttgcgtgatagcttgcgtgcgtcagaagatagccgtaagcctgaaaataaagtggcgttctttatttcggtttatcagcatttgcgtgagcgtattcgccaagacatcatcaaaacggacgatccgattgatgcgattgaacagatggaaatcgagctatctcgcttaactaatgaactgactagccgtgagaaaaaattggcgatcagctcagaaagtgtggcaaatatcttacgtaaaaccattcagcgtgaacaaaaccgtattttacaactaaaccaaggcttgcaaaatattgcgttcggtcaggtgaaaggggtgcgtttggtggtaaacattcgtgatacccacgcaattttactcaacgccttatcaaacgaccgtgagcaacatagcgatctgtttgagaaccaaaaactcagtttctcagaagcgttggcaatgctctacaaacgtgttaatccacatattgaactagggcaacgtacaccgcagaccattggcgaagagctattggactaccgtaattatctcgatctggaagttgaaaccttccgtggtgcagacggttggatgcgtgcggaaagtagtgcgttatcgacaggggaagcgattggtacgggtatgtcgatcttgttaatggtggtgcaaagctgggaagaagaatctcgccgtatgcgtgctaaagatattttgcctgctcgtttgcttttccttgacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcagctcgtttagacgcaacctcgatcaatactctgtttgaactctgtgagcgtttggatatgcagttgcttatcgccgccccagaaaacatcagcccagaacgtggtacaacctacaagttagtgcgtaagatcacgaataaccaagagtatgtacacgttgttggattgaaggggtttgggagggtttagtagacaaaagtagctttaagtcttggagagtaggggattaaagctactttatttagctatgtttttggcttcttacagttcaggttttcctctttcctagctaggataactagctgtcttctgtgatcaatttctcttttaatccccgctttctcgaagccatcgttaatcaccgcttgaatatccacttcacaagcgacttgatagagctgttttgcataatccgcttgtgggtattcccgattttcaaagcccaaacgccctttgctatccgcttcgcaaaccaataaaaaatcaaaaaaacgttcgggtttacgccatacatcaagtttattaaacaatttcaccacggtttcagggcgtagctctgtgattttatggctatgggtgtgaaattccgtcaccagtttagcgaatgctttagtgtgagcttgtactttcaagcgatttgccagttgctctgttggggcaacgcctttctgttcgtgtccataatgatggggcagaatatcctttggggttagagctttgccaagatcgtgacagagtgcggcaaataacacactttcaggatcatttgcttgaaccgctaattttttcgcctgctccaaaaccatcaaggtatgaacgccactatcaatttcagggtgatatttttcaggttgcggaacgccaaagagtgcttccacttcaggaaatagcactttcaatgccccgacttctcgtagcacttggaaatagatgtgtggcgtgtcggtggcgaaggctttttgggtttccagccaaacacgctctgctgttaaatgagctaactcaccgcaagcggtcatttcttgcattaattttaccgtttcaggagcaatccgaaatccgagagaatggaagcgtgcggcaaagcgagccacacgcaacacgcgtagcggatcttcggcaaaggcaggggaaacgtggcgaagcaggcgatgtttaagatcggcaatccccccgtaaaaatcgtggtagttgccgtcaagatcttgagcaatcgcattgatggtaagatctcggcggattaaatcttgttcaagagtaacctcaggggtaaagtcgcagataaaaccgttatagccattgccgtttttgcgttcggtacgggcaagggcgtattcttctttggttttagggtgtaaaaatacggggaaatcgttaccgacttgttgatagccttgagctaaaagctgttcgggcgttgccccaacaatcaaccaatcacgatctttgactgctaagccgagtagttgatcccgtactgcaccaccgacaaggtagatatttgtagtggatattatcataggtatattaattcggatatattaggattggtgtattaagaagcattattctatgtattccaccacatcagagattgcttgaccggtcttcgctttaggttctaccgcacgataaccaaaggcgaccatcacactaagtttatagactttcggatcatacaaccctttttcgacaaaaagctgatccattttttccaatgggaaaccttcaatcgcggtgctatcaatgccaatcattgctgaagctgttagcatattggctaatgcaatatagctttggcgacaagcccagtgataaaacgccacaggatcttgggtcaagccaaaatccttttcactgaagttacgataaaaaccttgacgcatttttaacgcttcttcaggaatatggtgaacatctcgcataatatgttgtacatattcgccgtcagcaagcagagtttcaggctgacgaacaaggatcacaacaaaatggctacaatccatcaccttatcttttgccccccacgcattatcacgaataagctcacggatagcgtggttttcaatcactaaaaatcgccacggctcaaagccaaaagaacttggcgataaacgccctgtttccaaaataaattggaaatcttcatcactgatttttttcgttggatcgtattgcttgcaagcgtggcgataatggaaggcatcaagaatagcttgtttagaaatagacataatttgtttcccctcaatgaattgattaccatattatgatacgctttacttaaatttcaaaatatcaaggagtaaatatgtcaaaaacctttagtgaccaagccgattgttgtggtggtatttgtaaaccaagtagtacgtctatgttcgacaatgcggacagcaccattgaattagcccttgtctatccaacccaagcagatgcagaacaaggactggctacatcaacggcaaaagcaagagaagttgaaagcgatccgtgtgacatcagtagccaaattagccaaactgaagatggttttttgttacaagcaaaattcttatttagttgccaagcggaagcggtgatttttcagatgaagttgagatagctcatgcttattgtattaatgaaaaatgatggactatcttgaccgccttattgaacttacccaaattcaaggggaaattaatgtgctgtgccgttttaatggtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattgtgggagaggctcttgggcgaggttgtggatctcgagttacccaagtaccaccttgttctgaggctttacttgagccaacatatactggaatattgctacgcaccgcaggcaacaaggtcgctgggtgtaaaactttcgcaccgaaggttgccatttccgcggcttcgttaaagctcattgtatcaatacgttttgcagcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatgcctggcacatcagtccaaattaacacatcatttgcatttaacacttcggctaacaatgctgctgaatagtcactaccgccacgtcctaatgtggttgttttgccttcatcatcacgaccgataaagccttgagtaatagctactttgccttctgcaattaatggtttaaggatagcatctgattgagcttgggttttctcatcatttggtgcggctttgccgtaatggttattggtggcaacaatctctctcacatcaacccatacagcaggataattacgctcttttaatagctgagtgaagattttagtggacatcatttcgccgtggcaaattaattcatcagtgagggctgccgaagtcgcaaggcttgcagagaggctagggctgaaacgtgttctaacaatgcgtcaatttctgcagaaactgccgcagggttttgtaatttttcgataatgttatattgaatggtacgaactgccgctaaaatttcttcacgacgctctgcttcacaaccattcgccagttcaactaaatagtttgttacacctgcggaagcagataacacaacaacccgagtatttgcgtctgcagtaacgatatttgcacaggcagacattgcttcaaaattggcaacgctggttccaccaaatttagcaacagaaagatgagacataaaaatttcctataaataaaattgtgtttgcaatgaagtaaaaaagataggaaatgggatgtttggatgcaggttatggcatacaaaccttgcgtgtcagtatctggttggcagaggaaaacgatagatttttttatggcattgaggaaggcactgatttggaattgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctaatcaatttagcccctaaaaattgtaatgttataataacctactaggcccaaaaggcggagcaatgatccaaagatgttttagcggaatattgctaggttctgctgaagaagttcgcaagcagttttgaaaaccataactgccataattctcgctggttaaacattttcccgtattggggtctgtcagaataaatgcccccgtatcggttgggactaacctaaataaagtgtctgtttgtccacagggtaaagtaccaccatctccaactaaacatcgattttctttaccaaatacttgaaattgaacgaaccgacgatttttaacaataacatcaacaagtcgccactgcacctctcttggatcattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttaarctgcgtaaagagataayagggggctttatttcaacaacatcaggataagttgatggtgttggcgtaggtgcaggtggcatcggtggtgtttctgcaagggaaaactggcatastcctaatgtcatcaataaagtaaaacgctttarcatagttcccccttaacgttttttyacaaagctgactgggaaatgatcrgaggtaatctgcgatctcatctgattaaacataatrctggcactgaccgtygtrttttgtgtggtttgattcgcattgtgtaacactgcataatccaatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaataagtgggctatccgcccgcttatttgcttatcttatttatagccttaaaacgctacgctctcttttaaacttaccgttaagttaaagacgagattatctgcactaccgtctttactgtctaaacagtaatagccttcacgttcaaattgataaccttgttctgcttttgcattcgctaaacttggctcaacaaaaccttgtttaaccactaacgatgttggatttaccacagaacaaatatcttcttccgcacctggatttgcaacggtgaacaagcggtcgtaaatacggaattccgcaggtttattatgtaatgcagatacccagtgaattacgcctttcacttttcgtccgtctgcagggtttttacctaaggtttcaggatcgtaggtgcaataaattgtagtgatcttaccgcttgcatctttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctttttctacatgttccgctttaatcacataagcattacgcaaacgcacttctttgcctaatacaagacgtttgtactgtttgtttgcttcttcacggaagtctgcttcatcaatgtaaagttcacgggtaaacagcaattctcggctgccaagttcttcacgatttgggtgatttggtgcggttagccattcttcgccttcaaagttttcaatcacaactttaactgggttaatcacagccattgcacgcggtgcgttggtatttaagtcattacgaatacaagactctaatgcactgtattccaccacgttatcttgttttgttacaccaatacggcggcagaattcacggatagacccaggggtatagccacgacgacgtaagcccgaaattgtcggcatacgagggtcgttccaaccatcaacaataccgtcatttaccaatttcaacagcttacgtttagaggttaatgtgccttctaaatttaaacgtgaaaattcatactgatgcggtaatggacgttcaatcgaaatgttttctaatacccagtcatacaaacggcggttatcttggaactccaatgtacaaattgagtgagtaatacgctcaatcgcgtccgaaatacagtgggtaaaatcgtacatcgggtaaatgcaccatttatcgcctgtttggtggtggctcgcaaatttgatacgatacaatacagggtcacgcattacgataaatggtgaagccatatcaattttcgcacgcaagctcatttttccttcttcgatttcgccatttttcattttttcgaataacgctaagttttcttcaatcggacgatcacgatatgggctgtttttacctggttcagttaatgtaccacgatattcacgcatttcatcaggcgacagctcatcaacataggctaaacctttgttaattaattcaatcgcatagccgtaaagttgatcgaaataatcagacgcataacgtggctcgccttcccattcaaagcctaaccatttcacatcttctttgattgaatcaacgtattccacgttttctttaacagggttcgtatcgtcaaaacgtaagttacataaacctttataatcttctgcaatcccgaagtttaagcagatagattttgcgtggccgatatgcaaataaccatttggttccggtgggaaacgagtatagacgttgttatgttttcctgaggctaaatcttcatcaatgatatgggtaataaagttggcacgaacatcgtggtgttcgtcgtgtaaaatctcttcgttgctcataatcgctctcttactagtaaaaataacgaaacattctacacgcgattaaggcgaactcaaaatagttagcccaatttgtgataaaaattgactaaaaaactactaacccttacaatttgcttccgcttatgacctactacaagcggtaggattcctcaaaaattttgcaaacacatctctatttaaggaacctaaaatgaaaagatccctttctatcgaattttcccgtgtaacagaagcggcggcactggctgcatttgcttggcttggtcgtggtaataagaatgctgccgacgatgctgcagtaaaagccatgcgttttttgttgaatcaaatggaaattcgtggtgaagtggttattggcgagggggaaattgatcaggctccaatgctttatatcggtgaaaaaatcggtttatgccgtcctgaagatgaagaagtcagcattgcggttgatccgattgatggtactcgtatgacagcgatggggcaagcgaatgcattatcggtattagctgcggggggaaaagaaactttcttacaagcccctgatatgtatatggaaaaattggtagttggcagtgaagctaaaggtatgatcgatttaagccttcctattgagcaaaatctacgtcgtgttgcctctaaaaaaggaaaattactttctcaactaaccgttgcggtgctagataaaccacgccataaagacgttattgctgaaatgcaaaaattaggtattcgtgtgatggcgattcctgatggtgatgtggctgcagcagttcagtgctgtttacctgaagcagatttagatatgttatatggcattggtggtgctccagagggtgtcgtggctgcggcagcagttcgtgctttaggcggtgatatgcaagcgagattaattccacggaaccaagttaaaggtaattccttagagaattttgcttatgcggaaaaagagataaatcgttgcgaagcattgaatgtaccgattaatgaaatattgaagcttgaagatctagttagagatgataatttagttttttctgcgactgggattacttcaggagatttgcttaagggtattctacgtcaaggaaatttagcagtgacagagaccttacttattcgaggacgttctcgtactattcgtaaaattcagtcttatcattatctagatcgtaagcaaacggaatgatatctactttaaagcatggataaatattattacaactaagtttggttttatgcagaaattagtccaacgtcgtccccaattaacagaacaacgattatcagaaaatcctctattaaaccgtatctatcaaagtcgaggggtaaaaagccctgcagagttggatttatctctcaaaggtttacatcaccctaaagggcttgccaatatggaacaagccgtggatttactgttagacagtttaactcgacaagatcggattgtgattgtgggggattttgacgcagatggtgcaaccagtaccgctttggcgattttggcgctacggcagttcggttttcagcaggttgattatttaatccctgatcgcttttcacaaggctatggcttaagccttagtgttgcggaaatggtcatggcaaaaggggcagattttgttttaacggtagataatggcatttcttcttttgaagggattgctttacttaaagctcaagggattcgggttcttgtaaccgatcaccatttacctgcagacagcctgccaaatgcagatgcaatggtaaacccaaatctggccgcttgtacttttccctcaaagtctttggctggtgtcggggtgattttctatgtgatgatggccctgcgagctaaaatgcgtgagctgtgctacttcaaagagaaagagcctaacattgcagaattattagatcttgttgctttaggaacagttgcagatgtcgttccgcttgatcacaataatcgcattttggttaatcagggtttaaatcgtattcgttcagggcattgccgagtggggatccaagcattggcagaggtggctaaacgagatctctatgctttgcaagccagcgatctagggtttgccattgccccaagattgaatgcggctgggcgattagagaatatgtctttgggggtagagctgttgatttccgataatctcgcgttggctcgtcaatttgccctagagctggattcattaaatcagactcgtaaagaatttgagcaagagatgaaagcggaagccttagccctttgtgctaagttgccaacgctctctcagcaaaatcaagcacaaggtatcgtgttatatcaacctgattggcatcaaggggtgattggcatcttggcttctcgcattaaagatcagtttcaccgtcctgttattgcatttgctcaggaaagtgatgatagtgaatatttaaaaggatctgctcgttctattgctgggctgcatatgcgagatttattagaacgtatcgatgctaaatatgataatttgattgtcaagtttggcggacacgcaatggcggccggtttgaccattcatcaagatcatttagctcaatttcaaactgtatttgacgaaaccgtgaacgaagttgcagaacctgaatggttacaaggtgtgatttatacagacggcgagttgttagccgatgaatttaatctagcaacggcagaactactcaaacaagcggggccttgggggcaacattttccagaaccgacttttgaggggaggtttcgtatcttgcaacagaaacttttggctggaaaacatctgaaaatgatggtggaaaatgaatatggtacgctattcgatgcaatctggtttaatgttgatgtaaaatgctatcctgatttatctattaaacaggcaacatttgtttataaattggatattaatgaatttaggggaggaaaaaacctccaactacttattgaatatttattagaagatgatcaattcaaataaaaaaagatagaataagacgattttgtgtagtagaatcatgctaggtttttattatagaaagaagtatagatatttctgataatattctatactaagagatagttaatttgacatttaagggataaagaatgaaaaaaacaattttttttcgtggagtattatcggctatagcgattacaattactgcttgtggtagtttgagtaaggtgtccgatgagggtacaacagaaaaaccggtatttccaaaaattccggaatcaaaatttaatcatgatggctctcaatttggatcatggccgaattgggaaaatgttcgtcaaattgaaaaagggatgaacaaagatcagctttataatttgattggtcgccctcatttttctgaaggactttatgaagtacgtgagtgggactatgcttttaactatagggaaaagggcgtacacaaaatttgtcaattcaaaattttgtttgataaaaatatgaatgcgcaaagtttcttttggtatccaaatggttgtaatggtaattcttcatttaatttagttggtgatttcctctttgattttgataaagatatattaactacaaagggcagagaggttgttgataatgttgcagaacaattaaaatcttcaggtgcagagaaggttaaacttgtgggttacgctgatcgcctaggttctgaggaatataacttagatttgtcacaacgtcgtgctaatatggttaaagctcgtttagtagagcaaggtattaaagtgccgattgaggctgttggttatggtaaagcaaaccaagttaaagcttgtgatggtgaatcaggtcaagcattacgtgactgtttacgtccaaaccgtcgtgtggaaattacagctaatggtggtgtattaaaacagaacgaaagtggtaatgttgcaggtcctcaaggcccagctccgctttatcaaactccttcatataatccagctaaataatttgctgctttgatgtttatgacgtagtaaaataaaagggtcaattcgtaagggagtgaccctttttttgttttataaggagcgaagtaatgtcttatcaagcgattgcattcgaccttgacggcacactgctgtcaagtcaaggcaccattttagaatcaagtaaaaaagcaattaagcaagcacaagagaaaggactaaaggtttatattgtgacgggtcgtcatcatacggcggtacttccttattatgcagaacttgggttagatacccctgttgtctgttgtaacgggacttatttgtatgattttcagaatgataaagtgttatcggctaacccgttaggtaatgcattggcagaaaagttaattcattcagcaaaagcagaagggattcatgttgctgtttatactcgtgatgcgatgacctacgaagtgctaaatgctcatttagccaaattcttaaaatgggtggcaagttgtcctgaaaatgttcgccctaatgtgtatcaagccgaaaatttccaaacctttattgataatggcacaaccatttggaaagtgttaattagcgatcctaacctagagaaaatgcaaaaatttgtcgaaacattaccgcttgaggtgagtgctgaatggtcttgggtagatcgtgtcgatattactaaagcaggaaatagcaaaggggcttgtttggcagaattattaaaacgtgaacaaattgatacagagaatgtgattgcctttggtgataattttaacgacattagtatgttaaaactggttggtatggggattgcaatgggcgaatcagagctggaagtccagcaaagtgcgaaaaaagtgatcggctcaaataacgaagacagtattgctcaaacgctaaatgaattattacagctaaattaaaaggatctatgaatgcatattcgcaaatcagttgaaacggattttgatgctattttagccatttataatcaagcgattccgacccaccaaatgaccgcagatctttattttgcaacaagagaaacacgcaaagcgtggtttgaatttcatctatctagtgagaaatatcccttatggacagtggaagatgaaaatggtgtaatcggctggtttagcttttccccatattatgaacgcccagcatttgtgcatacttcagaaatcagcctttaccttgatgaaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaaggtaaaggctatggctcgaaaattatccagtatatgcaagataagatgctagagcatgggattcatactttgatggcgtatgtttttgaattaaatcaagtaagtatgaatttaatgaaaaaacacggctttgagtgttgggggcgttttccaaatattgcgaatatggggaaagacagcgatggtaatgaaaaatggcgaacacttgtaatgatgtcttatcaaaagggcattgaatagcggtaggattttagaaaaaatttgcaattttggtggaaaacatttgcatattgaagccgaattttgcaagctatcgtattatttaacaaaaaagatatacaggagaaaattatgtcaaaacctcttttttcaggcagtattgtggctttgattaccccaatgaaacacggagaaattgactttgatggattaaaagagttagttgagtttcatattaaagcggggacacacgctatcgtttctgttggtacaacgggtgaatgtagcacattaagtattgacgaaaatgtgaaagtgattaagaaaaccgttgaatttgcagcaggacgcattcctgttattgcaggtacaggttcaaacgcaacaagtgaagcaattacaatgacaaaattgcttgcagacagtggtgttgctggctgtttgagtgttgtaccttactacaataaaccaacccaagaaggtttatatcaacattataaagcgattgcagaatgtacatcgttacctcaaattttatataacgtgccaggtcgtacgggaacagatttaaaacctgaaacaatcgcacgtttagctaaaattccaaatatcgttgcagtaaaagaagcaactggtgatctaagccgtgttgcacaaatcaaagcacttgctggcgaagattttatcttcttaagtggcgatgatgcgactggtttagaatcaatgaaattaggtgggcaaggtgtgatttctgtaactaataacctagctgcagcagatatggcaaaaatgtgcgaacttgctcttgaaggtaaatttgatgaagcagaagagatcaaccaacgcttaatggatttacatacaaatctgtttgttgagggcaacccgattccagtgaaatgggcagctcataaaatgggattaattagtgatccgtgcttacgtttaccgcttacagtattatctgaacagtatcatccagtaattactgcagcattacaaaaagcacaattaatctaaaatgttctaagtcaaggttggttttccagccttgatttttttgtaaaaacttagcgaatcttaccgcttgttttctaccaaaatcttccaaaatcgcttataatctcgccctttcaaacttaaatgaattaaaccgaatttatttttaaaaatcttaaggtaatacaatgtcagaagtcgaaaaccaagaattagatctcaatggcgaaatgatcgctcgccgtgaaaaattagctcagttgcgtgagcgtggtaatccgttcccgaacacattccgtcgtgaagataaagcggaagatcttcacgcaaaatatgatgaagttgatggagaagcacttaaagctaaagaaattcctacggtagttgcagggcgtattatgttacgtcgtgtgatgggtaaagcgacatttgttactattcaagatgtcagcggtcagatccagctttatgtggctcgcgataatttgcacgaaggtgaatatgaaaacacggtgggcttattagatttaggcgatattatcggtgtaaaaggcacgctatttaaaaccaaaacaggtgaattaactgttcgtgcagccgaattacaactgctcaccaaagcgcttcgtccgttaccaaacaaacataaaggcttaactgaccaagaaactcgctatcgtcagcgttatttagatcttattgcgaatgaagaatctcgccgtgcttttgttatccgctcaaaagtggtatcaggtatccgtcaattcttcttagagaaagattttatcgaagtggaaacgccgatgttgcaggtgatcccaggtggtgcagcggcaaaaccctttattactcaccataacgcattagatgtggatatgtatctgcgtatcgctccagagctttacttaaaacgccttgtggttggcggttttgagcgtgtattcgagttaaaccgtaacttccgtaacgaaggggtgtctgttcgtcacaatcctgaatttacgatgattgaatactaccaagcctatgcagattaccacgatttaatggataacaccgaagaattattacgcaaattagccttagatattttaggtacaacgaccgtgccttacggcgaatatgtgtttgatttcggtaaaccgtttgaacgtatcacaatgcacgaagcgattgtgaaatatggcaacggtatttcaatggacgacctacacgatttcgacaaagcagtggcaattgcaaaaggcttaaatatcgaaatccaaaaatcgtggggtttaggttctatcgtcaatgcgatttttgaagaagtggcagagcatcaattaattcagccgaccttcttaatggctcacccagcggaaatttcaccgcttgcacgccgtaatgatgaaaatccagaagtgacagaccgttttgaattatttatcggcggacgtgaaatcggtaacggcttctcagaattaaatgatgctgaagatcaagcggaacgtttccaagcacaagttgcagcaaaagaagcgggtgatgatgaagcgatgttctacgatgacgatttcgttgtcgcccttgaacacggtttaccaccaacagcaggcgaaggcttaggtatcgaccgcttagcgatgattttcgctaacgcaccgtcaatccgtgatgtgatcctattcccagcaatgcgtcagaaataggtttaaacaagtggggacacactgcgtgtgtccgtaataaaaatattcaaagtgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaaagacgaagtgtgacttatataaatagacgccaagcgtggcgtccctacttttataataatccgttgggacacacgcagtgtgtcccaactgtgttacctgccacatatttgaggtcaaaatgcttgccattatttccccagctaaaacccttgattttgaaactaaaattgacggatttgtattttctcagcctgaactaaccgcttacagccagcaattaattgatatttgcaaacaattttcccctgcagaagtggcatcattgatgtcaattagcgacaaactggcaagcctaaatgttgctcgctttgccgaatggacaatggaacacaatgagcaaaacgccaaagcggcattatttacttttaaaggtgatgtttatacgggcttagaagcagaaacactaaccaatgctgaaatcgactatgctcaacgccatttgcgtatgttatcggggctatatggcttattaaaacctttagatttaatgcagccgtaccgtttagaaatgggaacgaaattggctaacccaaaaggcaaagatttatatcacttttgggataacatcattactcaacacctccagcaagccattgatgcacaagaagataacatcttagtcaatcttgcttctgatgaatacttcggggtggtgcaagcggagagattaaccgcaaaaattgtcaaacccgttttcttagacgaaaagaatggcaaatacaaagtgattagcttttatgcgaaaaaagcccgtggaatgatggtgcggtttatgttgcaaacccaaccaaccagcgttgaacagcttaaagcctttaattatggtggctattggtttgatgaaacggcttcaacagacaccgaattggtgtttaaacgtgaggaacaatagcataatgttacgaaactagttgttattctattggaataatttcttaatatataaattttcaaaatcttgtacacgttttattgaaaagtactggttttttgcttcagattcaagtaaaatccgcccgttttttgtccttgcagattaatgtaggcaaaaaacattttattttttattcactaaatcacacacatatcgcagactaagcgtcggggtgctgttgaaaaacggtcgatgacttaggatatgtggaggcaaaaccctttctgccgcggcagaaacaacaacaaggaaactattcttatggcacaagtatctatgcgcgatatgcttaacgcaggcgttcacttcggtcaccaaactcgttactggaacccacaaatgaaacctttcatcttcggtgctcgtaacggtgttcatatcatcaacttagagaaaacattaccgttattcaacgatgcattagcagaattaactcgcattgcaagcaacaacggtaaaattcttttcgttggtacaaaacgtgcagcatctgacgcagttaaagcagcagcagtagaaagccaacaattctatgtaaaccaccgttggttaggtggtatgttgactaactggaaaacagttcgtcaatcaatcaaacgcttaaaagatttagaagcgcaatcacaagacggcactttcgacaaattaacgaagaaagaagcattagaccgtactcgtgatatggctaaacttgaattaagcttaggcggtatcaaagatatgtctggtcttcctgatgcaattttcgttatcggtgcagactacgagcatatcgcaatcaaagaagcaaataacttaggtattcctgtatttgctatcgttgatactaacgcaagcccagctggcgtaaactacgttatcccaggtaacgatgatgcagcgcgtgcgatccaactttacttagatgcagcagtagcagcaatcaaagaaggtcgtggtcaagaaaccgttgctgctgaatttgttgcagaagaagcggctgagtaatcgtctttaaggcaagcccttaaaacacattcaacattgtgaagcaggggcaattatacccctgcttttttatctattaagagaggaataaaaaatggctgaaattacagcagcattagtaaaagaacttcgtgagcgtactggcgctggtatgatggaatgtaaaaaagcgttagtagaagcaaacggtgatatcgaattagctatcgacaatatgcgtaaatcaggtcaagcgaaagcagcgaaaaaagcaggtcgtgtagcagctgaaggtgttatccttgctcgtatcggtgcaggtttcggtgtgttagttgaaatgaactgcgaaactgacttcgtagcaaaagatgcaggtttcgttggtttagcaaacgaagtggcagattatgcacttgcaaacaaagatacatcaatcgaagcattacaagcacaattcgaagaaaaacgtgctgcattagtggctaaaattggtgagaacatgaacatccgtcgtgttcaatacttagaaggtcaagtgattgcacaatacttacacggtgcgaaaatcggtgtattagttgctggtcaaggtgctgaagaagaacttaagaaagttgcaatgcacgttgctgcatctaaaccagatttcgtaaacccagaagatgtttctgcggaagtcgttgctaaagagcgtgaaatccaaatcgaaatcgcaatgaactctggtaaaccaaaagaaatcgcagagaaaatggttgaaggtcgtatggcgaaattcactggcgaagtttcattaactggtcagccattcgttatggatccgtcacaaactgtaggtgcttacttaaaatcagttaatacctctgtagctaacttcgttcgtttagaagtaggtgaaggtattgagaaagttgaagaagatttcgcagcagaagtagcgaaaatcactggcggtaatgcttaatttctctttgagataaaataacatccgcatgttttgtatgcggatgttattatgggttatttaataaaatacaaacgattaccccccgaatagactgttgcctttccttttcgagtaaaagcgagtagtgtaaagtcgttttcccttgcgatattgactgccatttcagtggtagccgaaatcgcacaaagcatttcaatgccacaagctaaacatttttgtaccatttcaaaactggctcggcttgtgacaaacacaaagccaagtggggcattttcttttgcataccagcctaacagtttatctaaggcaacgtgtcgccctacatcttctcggatagctaagagtgtgccgtcagggctaaaaaaagcagcagcgtggcttgccccagtttctttagcaagagtttgagcctgttctaattgagctaaacaatcatctaagattaaaggggatatatttgacaagcggtgcgattgtggaaaagtttggtaactctgtttgacttgttcaagttgttcaaccccacagatgccacagcctgttctgcctgccattgaacgacgtttctctttcaattgagtgaattgacgagtggaaatttccatttggatttcgatgccgttacaactttcaacaatgtctaagccgtagaggtcgcttttctgttttaaaatcccttcggcaagggaaaaacctaaggcaaaatcggctaaattgtcgggggtacacatcataactgtatgtgaaattccattataaacgagagccacaggcacttctctgatgatattatcttgttgaaattgctgttgtagagaaccattctcaacaaaaagtcgatctacatcaaatttagtgatcttcttcacattattcctcgaaaaaatttgtttattaagtagtttattttgttaaaaaattgtatcatttacagaattttagcttatatcaaatagatggtaattaatccgtaatagtgctgctttttaagttggtttagtaggataatatcattaattattttgttaggttgttaaaactattttataaggtattaaattatgttatttattaaatttttagtctttgttttttgcctannnnnnnnnnnnnnnntgattttggcattttttcaggctaaaaagcaaaggcaagaacaaaagaaaaagcaagaattattttttcagaaaataaaaaataactattctatagtaaaaatttccgatgatgtttactattataaaggggcttatttgacggacaaatatctaatagttaataattgcaaaataaggcattatgaagatcttttatttactaatcgccttttaaagtgcacttagtatttaatcctagttaatagacaaaattttattatttattaataaacaccgcaaatgcggtttggagtgatttatgcaggtcagtagaagaaaattcttcaagatctgtgcaggtggtatggcaggtacgtctgctgctatgttgggatttgccccagcaacagtattagccgcacctcgtgaatacaaactattacgagcaaaagaaactcgtaacacctgtacttattgtgctgtaggctgtggtatgttgctatacagtcttggcgatggagcaatgaatagtcgtgggaaacttattcatattgaaggggatccagaccacccagtgagccgtggggcgttatgtccgaaaggtgctggtgcgttagattatgtaaatagtgatcgccgtgtacgttatccagaagtgcgtgaagcaggctcaaaagagtggaaacgtatttcttggcacgaagcaattgagcgtgttgctcgccatatgaaagatgaccgtgatgctaactttattgagaaaaatgaagcgggtgaaacggtaaaccgttggatgacagcaggtttcttagcaggctctgcgtgtagtaatgaaacgggtattcttactcaaaaatttgtacgttctctcggtatcgtttttactgacaaccaagcgagtatctgacacggaccaacggtagcaagtcttgctccatcatttggtcgcggtgcgatgactaaccactgggttgacattaaaaacgctgatctcgttattgtaatgggcggtaacgccgcagaagcccaccctgttggcttccgttgggcgattgaggcgaaaaaacagaacggtgcgaagttaatggtggttgatccacgctttaaccgtactgctgctgtggctgacatttatatgccacttcgtccaggtactgacattgcattcttatcgggtgttattcgttatctcttagaaaacgataagatccaacacgaatacgttaaacactataccaatgcgacattcttagtgaatgaaaactttaagtttgaagacggtttattctcaggttatgaccctgaaacgcgtaaatacgaccgttcaacttggggttatcaatttgatgaagaagggcaaccaaaacgtgatatgacaatgcaagatccacgttgtgtgatcaatatgctaaaaggacacgtttcacgttatacgcctgaaatggttgaacgtattacgggtacaccacaaaaagatttccacattttctgtgaagaaattgcgaaaactgctgcaccagaaaaagcggcaacgttcctttatgcgttaggttggacacagcatactgtgggttcacaaaatatccgtacaatggcaattatccagttgttattaggtaacattggggttgcaggtggcggtgtgaacgcattgcgtgggcactcaaacgtacaaggtatcaccgacttaggtttattcccaaatcgtttaccagcttatcttccattaccaacggaagcggatacttctttagagaaattcttaggacgtattacgccgaaacagatgatgaaagatcaggtgaactattgggcaaatacaccgaaatttatggtgagtatgctgaaatccttctatggtgataaagcgacgaaagataatgaatttggctaccattacttgcctaaattaccaaaagacggaatggatcatatgcgttacattgaagaaatgtatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaatttaacgacgtgaaaaccgaagaaattcaaacagaagtattccgcttgccaaccacttgtttcgttgaagaagatggctcaattgctaactctggacgttggttacaatggcactggaaaggggcagaaccaccaggtgaggcgaaaacagacggcgaaatcctctctgaattgcgtgcggaattaattcacctttatcataaagaaggcggaaaagcaccgcttgaaccgttggaggcaatgagctggaactatgcaaatccacttgaaccaaaagcagaagaagtggcaaaagagaataacggctatgccttagaagatnnnnnnnnnnnnnnnnnnnnnnnnnnnttgaaaaaaggtcagctactttcaagctttgcacaaatgcgtgatgacggtacgacttcaggtgcgtgctggatctacacgggtcaatggacagaaaaaggcaaccaaatggcaaaccgcgataactcagacccatctaacttaggtaataccttaggttggggctttgcgtggccaatgaaccgccgtatcatttataaccgtgcctctgcggatttatcaggcaaaccgtggaacccgaaacgtcagcttgttaaatggaatggtaaaaactggaactatgtggacgttgccgactttggtgctgcaccgccagatagcccgacattgccatacattatgcaacctgaaggggtaagttgcttattcgtgcgtgagcgtatggttgatggtccgttcccagaacactatgagccaatggaaacgccaatcggtacaaacccattacacccgaatgtggtttcaagcccagttgctcgtattttaccaacggataaagaacagcttggtacttctgctgagttcccttatgttgcgacaacatatcgcttaacggaacatttccactactggacgaaaaatgctctcttaaacgtgattgctcaaccggagcaattcgtggaaatcggcgaggcactcgcgaaagaaaaaggcattaataacggtgatatggtgaaagtcagctctaaacgtggctatattaaagcggtcgcagtggtgacaaaacgtatccgtgcattagtgtcagatggaaaaccaattcacactatcggtgtgccaatccactggggctttgcggcaaccactggagcgaaaaaaggtttctttgccaataacttaacggttcgtgcaggtgatgcaaatacacaaacgcctgaatcgaaatgtatgttagtcaatattgagaagattgtgggggcataatatgagtacagttcaatctcaagatattattaaatcctctgcaatttcattcttaactccaccgccacaggctcgtagtcatcaagtggaagtagcgaaattgattgatgtcaccacttgtatcggctgtaaagcctgtcaagtgggctgttcagagtggaacgacattcgttcaaccccagatgcagcttgtactggggtctatgacaaccctgcggatctcaatccgaaagcgtggacggtaatgcgatttaacgaagtggaagaaaacgaccgcttggaatggctgatccgtaaagatggctgtatgcactgttctgagccaggctgtttgaaggcttgcccatcaccaggtgcaatcattcaatacgcaaacggtattgtagatttccaatcagacaaatgtatcggctgtggttactgtatcgcaggctgtccgtttaatattccacgaatgaaccctgaagatcaccgtgtgtacaaatgtacactctgtgtggatcgtgtcactgtgggacaagagccagcttgtgtgaaaacctgccctacgggtgcaatccgctttggtagcaaagaagagatgaaagaatatgcgtctaaacgcattgccgatctcaaatctcgtggctacgaaaatgcaggcttatacgacccagaaggcgtaggcggcacacacgttatgtatgtgttacatcacgcagacaagccagagctatactcaggtttaccgaaagatccgcagattgatttaagtgtcaccctttggaaagacgtactcaaaccagttgctgcagtggcaatgggcggcttggttctttctgaaattgcacactatatcgcaatcggtccaaatacagaggatcttgacgaacacgaagaacaccacggtgaacagggtgaagaacataacggaggcaaagatgagtaagattcaaatccctaacgattaccgaatcgttcgccataaattgcctgctcgttggagccactggttactggtgatctgcttcttcaccacaggcttatcagggttagcatttttcttccctgattttgcgtggttagtggatattttaggtacaccgcaattagcccgaatgatccacccattcacagggattattatgttccttgctttcgtaaatatggttcgtatttactggcatcataatattccagagaaaaatgactgggtatggttgatcaacattgtggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattatgtggcgtcaatatttcgcacataatttctcaattccagtaattcgtattgcgatcttattccactcagcttgtgcctttatgttgttcactggcatcatggtgcatatgtatatggcattctgggtgaaaggttcaattcgaggaatggttgaaggttgggttacagtccgctgggcgaagaaacaccaccctcgttggtatcgtgaagaagtgttacctgaacttgaaaaagagtttgcgaagaaacggtaacgtcaaattaaatgtaattattgtatgccgatcatctaaatagttgatcggcttttttctttttaaagaatctgtttttattttgactgttttgtagcttaaaaattaagctaaattaaaattttattaattttgtagtaaattcaattgtaaacgtaaatgaaagttttattcttattgataataagttttatttatttctcttaatgagacaaaccaaaggagctttctatgcgtttaaaatctctcacccttgcgattttaagtttatttgttgccagttcagtctttgcaacggatttatcgaaagaaacccaaacttataaggaatttgtcgttgggcaaatcgatcaattagtgacagataccgagaaatttgtggggtatttgaaagctggtgatgtgcaaaaagcgaagcaaatctatccgcttgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccgcttgcacgtatgtactttgagcgttcagagccgattgcagagagttttggcgatttagaccctcgtattgatactcgtcttgcggatttaagcgaagaaggaaaaaccgagaaagattggtctggtttccataaaattgaaaaagtactttgggagcaaaataccacaaaaggcacagaagcgaccgctgatcagttgatcaaagatgtgaaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatcaaagatgtgaaagaattgcgtgcgaaaattccaacggcggaagtaacccctgatttaatgattaccggtgcggtggatttgttaaatgaagtatccaccacaaaagtaacgggcgaagaagagattttttcaaaaactgacctttatgatttcaaagccaacattgaaggggcggaaaaaaatttatgcgatctttaagccaaaattagagcaaaaagatgcgaaattggcaaaagagattgctgatcgcttccaagatgtgaatgtgttattggcgaaaaagacagggttacagatgttaagacgttccttctcttatgccagcggtgttgatccgaaaacagggcagtttgatgcaggcttgttgtttatctcgttccaaaaagatccgcaacaatttattaccattcaaaacagccttggcaatatcgacaagatgaacgaatacattacccatatcggtagcggattatttgcgtgctttgcaggagttaaagatgaaaatgattacttgggtaaatcattgtttgaacaactttaaccgcttttttgttgtatttacgctcagcttaacgcagggcgttgcttatgcaaaggtggaaaccagccacttatttgtgcatttatctgatgcgacggaagtcgttccctatcttttaggcagtgccgcactgctgagttagtataaagtaattcatctttatttacgttttatttacaaagttaagttccatatttcaaatgaaaattttttatacatttgaaaaattttttatatctatcatttttatttaacttattgatttttaactattggagcttttctctatgagattatgatctatatcaaaaattgtgattgttttgtaaagctatttttaatagaatgctacgcaaacgtttatttcatcattcccagcgtatataaattagccaaggagagcaaatgaaagaaaaagttaaaaataccacctcactcaagcaagataatcaattcatagaacagcttgcgaacgggtgttgccaagatccttttgcttatttaggggttcatcaagttgatgatggcgtgattgttcgggcttatctacctgaagcagaacaggtaacagttattaatgataacagtgagccgattgtgcagatggagcaaattgatgatcgtggcttctttgctgcgaatttggttggtgaaaaaactgacctttcctaccgcttgttagtgcgttatgcccacactgaaattgatattgaagatccttaccgtttccagtcccatttttccgatttagataattggttgctttctgaaggaacccacgttcgcccctatgaaaaattaggtgctcatcttgttacccaaaatgaagttggcggtattcactttagcctttgggcgccgaatgctcgccgtgtatctgtggtgggtgattttaactattgggacggtcgtcgccattcaatgcgttttcatccaaacagcggtatttgggatatttttgtgccaaacttgccaaaaggaacgctctataaatttgaaattttagatagaaatggacaaatccgtttgaaatcagacccttatgcgttctcagctcaattccgtcctgatacggcttctgttgcttctggtttacctgcgattgttgagagtgacgagaaacgtcgtcgtgcgaacgatcctgatcagccgatttctgtctatgaagtgcatttaggctcttggcgacgtaatttagaaaataactattggctaaattatgaagagattgcgaatgagctaattccttatgtgaaggaaatgggctttacccatattgagttattgccagtcacagagtttccatttgatggctcctggggttatcaaccaacaggaatttatgccccaaccagtcgtttgggttcacctgaaggtttacgcaccttaatcagtaaggctcacgaagcagggattaatgtgattttagactgggtggtaggacatttcccaaccgatgaacatagtctggcgtattttgatggtactcatctctatgaacattccgatccaaaagaaggttatcaccaagattggaataccttgattttcaattatggtcgtcacgaagtgcgtaactatttgacgggtaatgcgctttattggattgagcgtttcggtattgatgcattgcgcgtcgatgcggttgcctcaatgatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcaatgatttatcgtgattactctcgcaaagatggcgagtggatcccaaatcgctatggcggtcgtgagaatttggaagcgttagatttcttacgttcaacgaatgatatgttagcgaaagaaggcaaaggtggtgtgactattgcggaagagtccacttcttttgctggtattactcacccaacggaacatcacggcttaggctttgattataaatggaatatggggtggatgaacgatacattacgctatatgaagaccgatccgatttatcgtaaatatcatcacgatttaatgacctttggtatgatttatcagtatagcgaaaagtttatgttaccgctttcccacgatgaagttgttcacggtaaatgttcgttactcggtaaaatgcctggggattgctggcaacagtttgcaaacctaagagcatattacggttatatgtggggttatccaggtaaaaaactgctctttatgggcaatgagtttgctcaagggcgtgagtggaattatcaagagagtttggattggttcttgcttaacgatgaacacggcggttggcataaaggtatgttgaattgggtgcgtgatttgaaccgtatttatcgtcaatatccagcactgtatcagttggattacgatcctgctggctttgagtggttggtggttgatgatgcagagcagtctgtgtttgcctttgaacgtaaagcaaaagagggagcaagcattattgtggtcagtaactttaccccgatcccgcgtgataattaccgttttggcgttcacgaagatgcaaaatataaagaaattctcaactcagactccgcttactatatgggtagtaacttagggaatttcggtactattcaatgtgacgagattgagtcgcacggtaaaccttattccatttcgctcactatcccaccgcttgcgacgatttttatcgtcaaagaagtcaaaccacaagcggtgaaaaaagcgaaaaaatctgcaaaagtggtaaaaaaagcggaagagccgaaagtggaaaaaaccaaagcagtaaaagccaannnnnnnnnnnnnnnnnnnnnnnnnaaagcaacaaaagcaaaataatgtagggacacactgcgtgtgtccattaattacaaatctaataattcaaatgttctatattatgtagtagttacaaaaagttgattaaattcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaggggggatattattgttcccccctcagggcttcgcccagctccccccgtaaacagggggagcgaagatttcaaataatataattgtttaagatgtcggacacacgcagtgtgtccctacaataagtactaaggctgtatatgaagtatcttgcaggcagactatttccattaggtagccgattaactgaaataaatggagaaaaaggcataaattttgcattgttttctcgccgtgcaagcggtgtggaattagcaattttttgcgacggtaaagaaattcgtttaccgatgatcaaaaccgatgaaatttggcatttgtttgtggtcggtctaaaagcagggacgcaatatggctatcgggtaacagggtgtgtaaatgaagaaaaaggcgacctgtttaaccccaataaattactggtagatccttatgcgaatggcattgtaggacaacctgatttatccagtgatgaagcggtaaaatggtttcagtggaatgatccgagagataatgctcacctagctccaaaatctgtcgtggttgcacgagatacttttgattgggaaggtgactataaaccttttaccccttgggctgaaacgattatttatgaaacgcacgttaaagggtttagtaaacttaatcctaaagtgccgagcgaaattgcaggcacttttgcagggttagcccacgaaacgtcaattgctcatttgaaacgtttaggggtaacggcagtggaattattgccgattacctatcacattgatgaaccgcatttgcaaaaaatcgggttatgcaactattggggttataacgttttagggcattttgcggttgatcctaaattagcttataacaaagccgatccgttaaccgagtttaagcagttggttaaaacacttcacaaagcaggaattgaagtgattatggatgtggtctttaatcatacggcggaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtaaagatggacctatgttatctcagcgcggtattgataacgaagcatactattggttgaccgataatagtgaatatttgaattggacaggctgtggcaatacgctcaatgtatcatccgatgtcgcggtattgcgttgggtgattgattgcctctgttattgggttaaagagtgtcacgttgatggtttccgttttgacttaggtgccgtgttaggnnnnnnnnnnnnnnnnnnngaaaaatcagcattttttacagctgtttatagcaattcaaaattggcacatattaagttaattgcagagccttgggatattggctggagtggttatcaattaggcgcattccccaaaccctttgcagaatggaacgaccgtttccgtgatgatatgcgtcgtttctttnnnnnnnnnnnnnnnnnnnnnnnnnnnnnnnnnnnncgatttgcagggagtgacgatatttttgcnnnnnnnnnnnnnnnnnnnnnnnnnnnnaattttattaccgcacacgatggttttactttnnnnnnnnnnnnnnnntataacgaaaaacataactgggcaaatggcgaacaaaatcgtgatgggcatggacataatattagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgatggtattggcaggtgatgaactgggacatagccaacaaggcaacaataatagctactgccaagataatgagattagttggattgactggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaaagactggcatgaccattctaccaaagcattacagatattattagaagataaatggcttattttggtcaatgccaaacaagcaatgcaacaatttttattacctaagggtgattggcaaatacttttaggtgaaaaagaaaccactctaatgaccgatacgcttgcggttactctcaatcacattgaggtatgtgtacttcaaaggaattaatattcaccatcccaatttggagataacaatatgctaaaacaggaagcatcaactgacagacgtaatcttactgcacaaactttagttcttatcttggcaggcggtcgtggttcacgcctttatgaattaaccgataaacgtgcaaaacctgcggtttattttggcggtagccgtcgtattattgactttgctctctctaactgtattaactctaacttattaaaaattggggtgattacccagtatgcggcacactcattgcttcgtcacttacaacgtggttggtcgttcttaccttatgagcgtaaccaatatatcgatatgcttccagctcgtcagcaaattgatgagaacacttggtatcgtggtacagctgatgcggtttatcaaaatatggaaatgatgaaatcgcactatcgtccaaaatatgtgattattcttgcgggtgaccatatctataaaatgaactacaaccgtatgcttgaagatcacgttgattcaggtgcaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtaccgtaggctgtattgaagtgccacgtgaacaagcaaccgaatttggtgtgatggcagtgaatgaaaaattaaaagtcaaagccttcgtggaaaaaccatcagatccaccagcaatgccagacaaaccagactcatctcttgcttctatgggtatctatgtgtttgatgcagattatctctatgaaatgttagagaaagaagtcagcaacccagatacttcacacgactttggtaaagacattattccaaaagccgttgaacaaggcgtgatttatgctcacccatttgagcgttcttgcgaaggtcgtaacacaacaggtacaatctactggcgtgatgtaggaacgattgacagctattgggctgctcatatggacttagtgagtgaaaatccacaattagacttatacgatgaatcttggccgatccacggtcgtccacaacaaactgcaccagctcgtttcttctataaaaaagcgcgtgcgcatacccttgataactcattgattgcagggggctgtgtgattaccgatgcagagatcagtaattctgttctctttagccgtgttcannnnnnnnnnnnnnnnnnnattgagcaatctgttattctgccacaggtgaatattggtaaaaactgtataattaaacgtgcagtaatcgaccgtcactgtgacattccagatgggttacaaatcggtgtaaatccagaagaagatgcgaaatatttccgtatcagtaaaggtggtattgtcttagtttgccaaaaaatgttagacaaattggcaaaagataaagcggttgcttaatatgtagggtgggtcttgacccaccttttaaagtttatctatgagcggtgggttaaaacccaccctacatttattcacaacatcaatatagttaattaaatgaaaattttacatatttgttcagaaatgtacccgcttatcaaaacaggcggacttgctgatgtgatgggggcattaccctatgcacaacaatcggctggaaatgatgttcgagtattaattccttattatccacaagtggcttccaaattaggcgaaaccgttgaagttgcaaccgtcggtacctttgcaggtgtcgtcactattcgttttgcttatttgaatggcttaggcgtatatgtgattgatgccccacatctctttgatcgccgtttgccttactacgacgataactaccaagattacaccgataactacaaacgttttgcactattaggttatctcggggcacaacttgcttcaggtttagatcattggtggggtagaagtgatgtgttacacgctcacgactggcaagcaggtttagcttgtgcttatctcaaaagctggaacagccctgtgaaaagtgtcttcaccattcacaatatcgcctaccctggacgtttccaagcctaccacttagcagaattagccttgccttgggaattttataatgttcacggtttagaattttacggcgaaatctcttatctgaaagcaggtttattctacgcagatcgtgtaacaaccgtaagcccaacctatgctcgtgaaattactgagcaaattgcaggggcaggaatgcacggcttactgcaacaacgccttgcagaaggggcattgcgtggcattttaaatggcgtagatgatgctgtttggaaccctgaaaccgacacaaacatcgtggcaaattaccgcccgaactatatgcaaggtaaaggtaaaaacaaatcggaactacaacgttactttggcttgccagaagataaagatgcactcttatttgtgatggttactcgcttaaccgaacaaaaaggggcagatttcttacttgcacgcattgaccaaatgatgcaacacaacgttcaacttgtagtgcttggtagtggatcgcctgacttagaatgggcattgcgtgatgcacaatctcgttacccacataaaatcggcttaaaaattggttatgatgaagctctttcacaccaaattatcgcaggtggtgatgttatcttagtcccaagtcgctttgaaccttgtggtttaacccaactttacggcttaaaatacggtacgctaccattagttcgccgaacaggtggtttagccgatactgtcaatgacgcacacaaagaaagcattgaaaaccgcacagcaacaggatttgtgtttaactatcctgacgcagataatttctacgatgccgtactgcgtgcgatcaatttatggggtaaaaataaattgtggtcgagcgtacgccaaaatgcccttgctcaagatttcggttgggcaaaagtggcacagcagtatcaagagttgtattacgagattgtctaacaaagatagatgggctaatagcccatctttttggcaaaaaatttaacaaatctaaccacttgtaaatttacaactcaactaaatctctgtataatccgctcgcaatttttccagttttattttttaactttcaaattaaggaactattgcaatgctacgagtaattaaagaagcactgacttttgatgatgttcttcttgtcccagcacactctaccgtgcttccaaataccgcaaacctttctactcaacttaccaaagacattcgcttaaatatcccaatgctttctgcagcaatggataccgtgacagaagctaagttagcgatttcccttgctcaagagggcggaattggctttatccataaaaatatgtcaattgaacgccaagcagatcgtgtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacgtggcaactgctgaaggtgcgattgcccttgctgatgcgggagcaagcgcagttaaaattggtatcggtccaggttcaatttgtacaactcgtattgttacaggcgtaggtgtgccacaaatcacagcaattgctgatgcggcggaagccttaaaagatcgtggcattcctgtcatcgcagatggtggtatccgctattcaggcgatattgctaaggcaattgctgcaggtgcatcttgtgtaatggtgggttcaatgtttgcaggcacagaagaagctccaggtgaaatcgagctttaccaagggcgagcattcaaagcctatcgtggaatgggatcattaggggcaatgtcaaaaggttcatctgaccgctatttccaatccgataatgccgcagataaattagttcctgagggtatcgaaggtcgcattccttacaaaggcttactcaaagaaattatccatcaacaaatgggtggtttacgctcttgtatgggcttaactggctgtgcaaccattgatgaacttcgcaccaaagcacaatttgtccgcattagtggtgcaggtatcaaagagagccatgttcacgatgtaaccattacgaaagaagcgccgaactatcgaatgagttaattttttgctacgcttggtgtcctgctttattcgatggacaccaagcgtgatgccccttgtttctttctttgatacataatactgaaaacaagcggtaaaataatgggaaaatcttaccgctaacaaggaatataaatgcctttaatcagaaaaataacaaataaaatcaacgatttttttcgcaaaaaacacaacgccaaaaatcgccaacgattaaacactaacaccctgactgtaattgctagtaactgcacaggggcttttatgttgcacgatttaggtttacgctttaattccccttttgtaaatttatttttaacccccactgattttattaaatatgtaaaaaatattgcccactaccaaacccaagaaatcactttccccaaagaaattcaaagaaaataccccgttgggctactaggcgatattcacatttattttatgcactatcattcagagcaagaagctgtaaaaaaatggcaagaacgcaccgctcgaatggatctcaataatcttttcattatgatggcagagcgagatggctgtcgctatgaagatctgcttgaatttgaacaactaccgtttaagaataaagttgtctttacccataaaccgtatccagaactaacctccgcagtttatattcaaggctttgaacaacagcaaaaaataggcgatctgtttgagtattgcggtttgaatgggaaacgtttttacgatcagtttgattatgttgggtggtttaatcagcataagcaaaactaagttagcaatttaataatggttgaaaatatggacatcaaactttttgaacacaaagaagtgcgttccgtttgggacgaagaacaagaaaaatggtatttttcgattattgatgtaatcgaaattttgacggaacaacccaattatcaaggtgcaaggaactattggaaagttctaaaaagccgtttattaaaagaaggaaatgaaacggttacaaattgtaaccagttgaaaatgagagcggaagatggcaagttacgactaactgacgtagccgatgtaccgcaactactgcgcttaattcaatccattccgtccccgaaagctgagccatttaaactttggttagctcaagtgggaagtgaacgtttagatgaattgcaagatccagaacttactatcaatcgagcaatgcaggattacttgcgattaggctattcggaaaattggattaaccaacgtttaaaaagcattgaaatccgtaaggaactgacggacgaatggaaacgtgtcggcgtaaaagaaggtcaacaatttgccgttttaaccgatattatcactaaagcgtggagcggaaaaaacaccaaaaaatataagcaattcaaagggttaaagaaagaaaacttacgcgataatatgacgaacaccgagctcattctcaatatgttagccgaagcctcagttaaagatatttcacaagcggtgaaccctgaaacctttgaagaaaatcaaaaagtcgccgaacaaggtggcaatgttgctaaagtggctttacaagagttagagagcaaaacgggtaaaaaagtcgttagtcagatttcagccaaagcgatgttggcggaaagtaaaaagaaattaaaataaagtgcggtcggattttgcaaaattttatataaataataccgcttattccccgcacggcaagcagtacggggttacgcataagtcagctccgttggagatggaagtgacaaatgaacaaagagctacgaagtagctcaattatgcttaacctagggcgtaagccctaggataaatacaatcaaaaatttaaggagtctttatgcttacattacaaataattggtggtattttaggtgctgttcttattggttatcttctctttctttttattcgtaaagtttttaggatatattggacgaaattcaaatttgatatattttctaaaaaaatctttattattgaagcaatcattggggttttatttacttctggtattattatttctgaagtatccatagataaatggaatggatatactctttgcttactatcttcattaatttttataggcttgctaacttatatttatagaaaaacagactttaaccatacgttattatcaattcctattattttgattattctaccatttctatcgataatagccctatttgttatatctgaatgggttctagaaaaatttggaattgatattgatgaatatatcgctatcaaaccttactagtaatttttacaaaacagagaaacacaatgacaaacatacacaaccacaaaatcttaatccttgactttggttcacaatatacccaattgatcgcacgccgtgtacgtgaaatcggggtttattgtgagctttgggcttgggacgtgacggaagaacagatccgtgaatttaacccaacagggattattctttcaggcggtcctgaaagtactaccgaagaaaacagcccacgtgcacctgaatatgtgtttaacgctggcgtgccagtgctgggcatttgctacggtatgcaaactatggcgatgcagttgggcggtttaactgaaacttcggatcaccgtgaatttggctatgcatctgttgaattgaaagcaaccgatagcttatttgcaaaattaaacgatgatctgaccgcttgtaatccaaaacttgacgtttggatgagccacggcgataaagttactcgtctaccgtcaaacttccaaatcactggtgtaactccaacttgtccgattgcggcaatgtcggacgaaagtcgccgtttctatggcgtgcaattccacccagaagtaacccatacgaaaagcggcttagaattactgaaaaatttcgtggtaggcatctgtggctgtgaaaccaaatggacagcggaaaacatcattgaagatgccgtagctcgcattaaagcccaagttggcgatgatgaagtgattttaggcttatcaggcggtgtggactcttctgttaccgcactacttttacaccgtgcaatcggcaaaaacttgcactgcgtattcgtagataacggcttattacgcttaaacgaaggtgatcaagtgatggagatgttcggcgataaattcggcttgaacatcattcgtgtaaacgctgaagaccgttttttagatgcactcaaaggcattgatgaacctgaagcgaaacgcaaaactatcggtaaagtattcgttgatgtgttcgatgatgaatcgaaaaaactcacttcagtaaaatggttagcacaaggcacgatttacccagatgtaatcgaatccgctgccagcaaaacaggcaaagcacacgtgatcaaatcgcatcacaacgtaggcggcttgccagattatatgaaactcggtttagttgaaccattgcgtgaattgttcaaagacgaagtacgtaaaatcggcttggcattaggcttaccagctgaaatgctcaaccgccatccattccccggtccaggcttaggcgtgcgtgtgttaggcgaaatcaaaaaagaatactgcgatttagtccgccgagctgacgcgatctttatggaagaactacacgcctcaggctggtactacaaagtcagccaagcctttactgtattcctaccagtcaaatcagtaggcgtaatgggcgatggacgtaaatatgattgggctgtttccctgcgtgcagtcgaaactatcgactttatgactgcacattgggcgcatttaccttatgatctattaggtaaaatctcaaatcgtattatcaacgaagtgaacgggatttctcgcgtggtgtatgatgttagcggaaaacccccagctacgatagagtgggaataatatcccacctattcacagcttttcatagtatttcaattttttttgcgtaaaaattgtcggtaaggattgagctgtttatcccttaatatcaaaataccgtcattaatttgacggtattttaaaataggggggaagaatgctgacagatagtaaaattaaatctttaaaagcaaaggataaggcttataaagtagcagatcgtgatggattgtacgttgttgtatctcctgctggcacggttacgtttaggtatgattatcgtattaacggacgaagagaaacattaacaataggaaaatatggaaaggacggcatatctcttgttgaagcaagagaaaagctaatgatggctcgtaaaatggtgagtgatgggatttctccagccacagaaaaacggaagaagaaaaatcaaataaaaagtgcgaataattttgaagcgtttgcacttaaatatattgccgaaactgattttgcggaaagtacaagagcattaagacttgcgacttacgaaagggaaattaagaagtattttggatataaattaatgactgaaatttccacagaggaaattagagggcattgtcaaattattggggataacttataacgaccctatcccaaattctgtgtaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagccttatactataaggctttgagccagtttttagcgactatgttgtctattacacctttctagagttatgttcagctttcattttttccaagagctgttcacttttcctgagtgtttgttcaatatttctaagttttttatcgtattcttcaaacattctatccatttcatcaaaatcaaacttttgaagtgccttgaatgtttcccatttttcttcttccgtcatacgagcaacgacttctttaacaagttgttcttcaaagttcattttcttatccttacatttggtaaaatgggtatattaaatactaactatgcacttatgaaaattcagtagcaaatttattagctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtagcaaatttattagctatctgtctaatttcattcatttctcttttattagatagttgaataatattagatttacatatacgcaaggttcctctaattatttcatccttgttatacttggtttttcctattgtataaatgaaatcataataagaattgatactcttggaatatatagataaaacagatatatacacctgagtatttaatgtatcctttgaatttataaatgaaataaatcggtcattgtcgagatgttttaatttattccaaagttcaattatgtgattttccatagaatttcctacagaacggctaatagccttggctactcgccctaaaatatcaaaaaaattcatattatttcctatttcttatttggtttaaagtttattgcaaatttctaaattcaatttaacaaactcttcccaactatacagatgagataaatgggctttatagtaatcttccactcggcaaacaagcggtcggttttcatagattttgcacaaattagtttgttcatcaaaatgatggcaaacgccatcaccacgatctaaataagcggtttgttcacttaaattcactcggcgacagcatttgccacaggaattgcaggggaaagaagctaaagaactcatttgactgctaaactagctaaccaatttctagtactttgctcattacctgattcatacggtaattctatatttcggcgatgaatctctttttctaacactatagaacgttctaattcggaattacaagcctcaaggctatctacaaatactgctatttcatttggatttaagttaaattcaatctttgcccattctaataaataacggtcaagctctgcattaatttcgttcatatgttctgtcattaattcatacttatttttatatgaattaattatttcccataactttttgaaagataatccattttcaataaaatatgcaaaagcacacgtcataagccctgtggctaaagcacttacaaatgctgctattaaatctcccattggaaaaataagaatagtatttagatgagagtttaacattgtacctaataatgcagataaacctgcactaagtatttttaatacgcctttaaacaattcttttgcattaagattatctggattaaaagtaattagtttaattacacttacaatgctattccacatttcacgaatgagctttaccaccattttttcagaaacaagaaatatattcattactgtagtgctaatgttgctaaaaaagcctgcaattgctccatctttaaatgcagttaaaagatctttaaaacgttcttttacacgttcaaaaatattacttaatgtcttagcaattttttctaaaaactttgtaatcgtaaagttttgttttagattttgataaatctcaggtattctctctcttaactcaaaccaaatttctgcaagaactaaacctaatgcctgacgtgttcccatttttaaaccagctttacctgctgcaagtgctgttgatttgaaaaatttggaacttgtataatatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacttgtataatatttataattaattttattattatatttatctctagcatctttttctattttacgacattgctcctcatcaagattttctaaaatttctttttttctttctaggattcttagctctttttcttttttagctcgttcttcttgagatagattactattattcagttcagatttcttttgggtaatctcttgtgccattttctcaactctttgatctctaacgccacctttttcaagaaaggttttaaagttatgatcatttttttcattatttataatccagtgtgtagaaactaaattatcttcgctatttgcaagctctacgccatctaatccagatagtattcgacctaaatcatcgtgtatttcacttgcagcgacaacatgatctaattctgtaacatactcaaattctttcccatttcgttccttcttgatatcatctgcattgattttctctccagtataaccatcaaccatggttcctaaatcttcttgttctttatctttagcttttcgttttgtatataatgtactttttccatgataatcatcttctttttttacttttcctttaccatctttttgaacatttccctgttgatcgtatttaactttcttataaggatctatatttcttccattagaatctaattgactagcaagttcatttgaaacatggattgttgaactccccttttgtttaatttctttttgatattctcgtgctttaagaacagtatcaacatctccaccacgcttatcttcaaaaagcaagaaatctaaaccaaaagtagtgactaatgaatttactaccgttttttctaattcacctgtccaatcaaattcaggcttagtcataagtacatttgacatatttcactccctataaaaaggcgagattcctctcgcctagcataatttactcaaaatcttttgatttatatgttgataacgtaatatgcgcatcaatatcttctttattaatgactttcataccatctttatctgtttcaaattcaacagtatcttctttgtttttaactaactctccattatcatcttttttaggtttaaataatggggtagtaataatatctgttaaaatagctgctactttataaccattatcaacaatcttaataattgctgatgagatggtattgatatcaactccattacgaactaaggtatccatatttttaagatcttggaaatattgaccaaaaatctgataaacacgattaagttctttatagatcttatttgaatattcctcagtttcttttaaatgatggcgaccaagtttcatactactaactgcatttttaacttgtgtacgataatctcttgctgattcaagttttttctccgaatgttttgcaaaagctaagccagcaactaatactattggagctacaacaacaccacctaaaattgctgcacctccagccattccaaagccaccagcagaaatagcaccaccaccaattgcagccatggtagctttatatgcggcagctccagaaagggctgcaataggagtgccagttgaagcagcagccaatgccattacaccaccgtaaacagcataagcagcaccagcaccaattgcagcccctccagctagttgccctaaataggcgacagctgaaaaagcaatcccttcaattttatctaattcatttttaggaatattaatttgtaagtctttagcttccttatgttgagctaatttttccaatagcaattcagaaatgcgtttgaattcagcaaagtctgaacctatggacaattgcaattgacctaatgattccaatgatgcattagttgcggcatcttgctcatcaaataactttttttctgtatcataaagactttcggcggcttcagtaatatcttttgcagcggaattatctttaaaaccatcaattccttttttaattcctgttcctatagtcacggcagcagcaccagccaaaataaacggtaaaggcataataaactcctatgcttaatctaacaataatgtaacttctctagataaagcaaattgcttttctacccagctttctagtgcatttaatttttcattagaaatacccagttttcttgcatacccagcaatcatatctttctcacttaaatgatattcttcatttgcgtgagcaacacctaataactcaagtaatagtgaacattttgctctttccgttgtaaataacgtaacaagttcatcaactgtaattgctttttctgttacaccatcttctgattgctttgttagaatctctaccatacctaattgcaattcatctgaagagccatctgctcgtgcaatttcgtgggctaagtaaattaatgcagattgttgctctgctgttaaattttgtacaaacatatttttctcctgttgtttgtgttggtttaattgttgatagaatacttttttctcaaaaatgcaatttggatcacagcaggtactgttacgcgagttgcaggacctgaaatatcttttaatgcccaaattcctgttatcccccaaccaataggacctgtggcaaagcctaaaatacgccctaaggctgtgcctgctaatagtgtaccgatagtttgaggaaacattgtatgaatagtcttccaaagaactggggtagataaaagagaatttaattcaactagaacaagagccgttaaagattgtttacctaaatgagtagctggaatttttaattcttctgctaatttttttaaatcatcttcagatagctcttcgatagcactagttaatactttatccaataaatgtttttcaataagttcggttgaactttctttattgaaatttactttcattttttcacaaacttcaataagaatagttttatatgaaacccctttccctagtctaaataacgtagcaatagtatttgctccgaatttctgaatttcttctgcaatctctttccaataaagattatgatcagggtaaaatactttgtaaactctagagcttgttaagccctccgtataacgttttttaccatctttatccttagttaaaatatctactaagggttgtagatcctcgtttgtacattgagctaaaaactctaaatcaacatcatagacataagccatataaaatttctcctaataattacagtttattccactcccccccaacccttttattcgcaagatctcgatagatttcacagtcggggtttaaggtcagtaatttatatagcaattgttacaaaagatagaaatactttagtgaaaatactaaatcatcgtttctttttttataaaaattgcggaatagatcatttaaatatctatatagtttattttcccttataaaaacatagaggatcctcctgtttatctgcctcttgtttcatttcttctgttggattttttatatatcgaatagcataaccattttctttaatcgcaagcaacttcatttcttctgttggattttcaatatattgaatagcacaaccatccacttttactgcagctagcttcgtttcttctgttggatttttgaaaatattaaaaggccaaccacgttgtataagctctactggtgtcatatcttctatacgctttttatatttaaaaaaagccattaattggttttgattcatcgccaaacttactcatcatatcttattcctttaaaaacattttttacgaagaaaattttttcttccaaaccaccccaacccttttattcgcaagatctcgatagatctcacagtcggggtttaagatcagtaaattatgtgctgcaattgctgcaagggataaaatgccccaacggggatttaataccgctgataagcctacggctaagcgatttttggtataaaggcgacacttcaaatttaaactttcaatatatttttcaagttcttgactaaaggcgaataaattacctgcatcaatgtcacaggtttcaaaactttgacgttcattaattaatgctttaatggttgaaaatggctcgctaatatcaatttttttcatatttccccctaatcattcgcaatatattgtttcaacttctccaccattttttcctgcaagccgttagggctgatgatggttaaatggggaatccaatattgcacaagcggtacgatgtcgagttcgtttacgttttcgctggctaaaataagttcgccgttttccgatttatgcactaatttttgattaggcagtaaatttcgtcgaaggaagtaaggggaggcaaagctggatactttaactaagacttcactgagctgattgccaaaagagatactgtcgttacttttgatctcttcttgtagctgttggtttggttcgaaagtttcatcaagcatcttgagcattgtgatttgagtgaagcagaacgttttctgtttgtcttcatctgtgccgattaaataccaaatgccatttttattgattaggctataaggggcgattttgtaaaatttgccatcaatctgaccgcttttcttatataaaaaatcgataaatttatgtgcttcaatggcttgtttgatcagttgaaattcgttgtctaagtggcgaatgtcttcatattgaaaacctttcactttgacgctgtcggtgagtttttcttgataaaaatcgcgatctacctttgggaaaaggtctgaaatactggcaaataacgcaaaacgagagatgtcttgctgagatagtatacctagtttataacggttgattttgtaatgtcgtggtccgctctcttcccattcgagaaaggctaaacgatctttaatatcacgttgaatggtgcgaacacttaccccaaaatcttctgcaagttgattaatatcaatgcgttttccttgattgagttgggataaaatttcactaagtcgttgtgctagaacagtattcttttgcatacatctaaatcctctgattttgaatgcgtgcagtgtacccgaatggtgacgacaggttgtgtcagctcaacaaaaaaatcagatttttataaaaatttttaaataaatttgctcttttattttatttagacctttgaagtctaatataagtattattcgctatttatcaaaaaaagtcaatgcctattatttctttctttataaagggagaaatcgtgtgttagataaaagtgagcaattaatacaaacgattgggcaagcgattgcgaaatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaggcttaacgcaagcgcaattagcggaaattttaggcattagtaatgatgctgtttcaagaatggaacggggcaaaacaattccaactgttttgcgtttgttggaactttcggagatttttcattgtgaagtagctgatttagtgaccgaaagcagtaaccgttcgaccgatcaagcgaaagttatcgaaaaattgttacaacaattagatagtcagcaacgatcagaattgctctatcttattgagcgattagtgaaatggaaaaatgagtcgtaacaggataaaaaataaggtggcaagccaccctattaaatgattacttaaacaccgcccacacaggtgcgtggtcagaaggtttgtccattgctcgaatttctaggtcaatgcctgtttcgacacagcgttcagccaaaggggttgaagcaagtactaaatcaatgcgtaaaccacgattatcatcaaaacctttagagcgatagtcaaaccacgagaacttatcttctgccgttgggttcattgctcggaaagtatcaactaaaccgtatccgtgtaaacgccctagccactctctttcttcgggtagaaatgaacatttaccatcacgcagccagcgtttgcggttcacttcgccaagcccgatgtctaaatctgttgggctgatgttcatatcgcccataatgataatcgggttttcaggcttgagttctgtttctaaataacgttgtaaatccgcataaaatttttctttagcagggaattttgtttcgtgactacggttttcgccttgtgggaaataaccgtttaagacggtaagggttccgaatggggtttcaagatctgccataatcatacgcttttgtgcatctgcgttgtccgttggaaaacctttacgcactgcaagcggttggtttttggttaaaagtgcaacgccataatgccctttttgtccgtgatgaaaaacgtgatagccaaggtgattgactaaatcgtaagggaaatcttcatctgccactttgatttcttgtaagccgatcacatcgggctgatgtttttcaataagcgcttcgagttggtggggtcttgctcgcaagccattgatattaaaagagatgaatttcatattgtcctttaaatctctctaaatgcctctttttcaaaggggatttaatgagagaaaatgaatttcctataaaatcattgctgcaatccaaccaaacactaataacgggatattgtagtggataaaggttggaacaacggaatcccaaatgtggtcgtgtttgccatcagcattcaagcctgatgttggtcctaaggttgagtcagacgctggtgaacctgcatcaccaacgtgagaaaccgaatgaaagacacaatggtacatagatagaggtaataattggtactgttgagaatgaagaaccgatccccatggtaattaataagccaacgaagagcattaagaatgcagccatacctttgcttccgatcgagtcttttaagccttcaactaattcagccacgccacctgttgagtttacaacacttgcatagcctgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgcaatcattacaaagccgatcatcgccattaaacgtaagccatcttggaaaatatcgttgctttgtttaagtttgaacacaccgccaacggcaaagataatcaaaccgactaagccacctaataccgttgagtttgttgataactgaacaaaacaggtagcaacaattgctgcgatactcacgccgatgtggaatgatttcacatttgctacacgagcttcaatatcatcagcggttggttctgggcgatcttccacataaacacgtggtttgcggtaggttacaaagaacgctaataataaacccacgatcatacccgccacaggaattgccattgcttgagtaacttctgcagtgttggtcactaggttaaatggttgccctgcttggttgatattttttaccaagatattttcgataaagatttgaccgaaacctgctggaattaacatataagttgccgttaaaccaaaggttaatgcacaagcgactgcacgacggtcaattttaagttggttcattacgctaagtaatggtggaacaacgattgggataaacgcaatgtgaactggaataacgttttgtgatgccattgcgaaggcaactaacgtaaagagtaccgcatatttaaaccaaaacagtgaacgaccagatggacgtttgccaaaggctttaatgattttatatgccagtaaatcggtaacacctgattttgataaagcgacggcaaaagcacctaatactgcatagttcattgcagtttcagcaccaccgcctaaaccaccagtgaaactttttacggttgtcgttaaagcctcacctaatgccattccgttgccagaattacctaaaataccgcaagttaaggcggcaataatcaacgcaattacaacgttaattcgcaataaacttaatgcgagtaacacgataatcgagatgaccacatcgtttgataataacattgtgttttcctcttaatgtaataaaaaaataaacctattattcaattctacgagataaaaaagaaccccttcgaaatcatcttccgaaggggtggaaattggtttttagatctactctcattttgcaccgctcggaagtttcttccgaacacgccaaatgcccgaaagattattcaggtaaatggtgatgacggtgacgaatgtttgagagaatgttcatagtagctccaaaattgaatgtgccgaaatatatcctagaaaaaaatgaaaagcaaacgtttatttcgctttttgcagattttttcgactaactcaccgctttaatctgaattaaaccgctttccgcataatctgctgcatcatctttatcttgaaccacaggagcagacggaatttctgctttatcaaaggcaatatctccttcaacaccgtcaattagctgaccacgtttaatgcctttaaaatcaaagagatttggatcgcatagatgtgatggagccacattctgcaaggcactaaacatcgtttcaatacgtcctggatattgacgatcccaagtctgcaacatctctttcaccacttgtcgctgtaagttaggctgggaaccacataagttacacggaatgatcgggaactgttttgccacggcatatttttcaatgtctttctctttgcagtacgcaagcggtcggatcacgatctgtttaccatcatcgctaattagctttggtggcatagatttgagctttccaccgtaaaacatatttaaaaaaagtgtttcaagcatatcatcacgatgatgtcctaacgcgattttggttgcacctagttctgtggcagtacgatataaaatcccacggcgcaggcgagaacagagcgagcaagttgttttcccttcaggaattttctctttcacaatgccgtaggtgttttcttcgacaattttatactctacgccgatactctcaagatactcaggtaaaacgtgttctgggaagcctggctgtttttgatctaaattcaccgccacaatatcaaaatgaataggggcgttgagccttaaattgagcagaatatccagcaaagtatagctatctttcccacccgataaacaaaccattactttgtcgccatcttcaatcatattaaaatccgcaatcgcattgcctacatttcggcgtaagcgtttttgcaatttattgaagttataggcaatttttttctctttttgcgtgtcttgaacatggtcttggtgcataatttaacaaattcggattaaacaaaataaagcggcacatagtaaccagtttgctatttttttcaagtatttctgaagtaggtcgggcatttatgcccgacaattattacaatccataaaatcaatataaaaccaattacataaacgtcgggcataaatgcccgacctacaaggaaaaatatgttaaataaacgcattattatcggcattagcggtgcaagtggctttcagtatggctacaaagctcttgaattgcttaaaccgctagacaatatcgaaacccatttggtgatttcaaaaggggcggaacttactcgccaatatgaaaccaacatcagcgaagaacagctactatcccttgccgatgtagttcaccctatccataacttaggagcttctatttcaagcggttcatttaagaccattggaatgcttatcgccccttgctcaatgcgaaccctagcgtcagtcgctcacggttttagcgataatttattggctcgtgccgccgatgtagtattaaaagaacgacgtaaattggtgttaatggtgagagaaacgccgttgcacttaacccatttggataatatgcgtaaagtcaccgaaatggggggcattatttttccgcccgtgccagcactttatcatcagcctaaaacggtcgatgaaattgtgacccatagcgtcgctcgtgcgttagatatgtttgatcttgagattgatattccacgctggacaggaaagtagatgaataatccaattcctacacacattgtgcaatttatcttgaaaaatcacgtggtgagccttgcttgccaccatcagcatcagctttggtcagccagttgcttttacgcttttgatgaagcatctcaccgcttgatcgtgctgtcaaagcaaactaccgaacacggcaaattgatgttagccaaccccaacattacaggcactattgcagggcaacccgacaacattcgagagattgaaggcattcaatttcaagccgttgctcgttgtcttgagaatgaacaagaaaaacaaactgctttacaaatttattggcaaaagcatccacttgcaaaattgatgagtagcgatgtgtgggaaattagctttacccgaattaaacatacggaaaatagagtggcgtttgcgaaaaagagtgattggaaaaagctcttttaacaatgaaagcatgtgaattaaaaaataatgaagaataaatgtatgtcttaactttaatatatttgggataaggtttatgtatttcacttttatgatatctttgttactagcctgttttccccgtacaataaccccaaaccacccaactttgagatcctcttatgtttaattctctttttgctcaagctgaaatgaaattgaatacgttaatgacgttacatcaaattcccgaacatccgcaacatttcccccaaatcctaccgcttatcaacgccattgcgatgtcggattttgtggcacaacagttgcaaaaacagccggaattattgaccgcttggcttgaaaaatcgcctgaaattgaggattgtgagcgttatgcagagcggttgcaagcggtgatttctacggtgaaaaatgaagaagaattacagcgtgagctacgtcgttttcgtcaccgtgaaatggcaaccttgagttttattcaatctaatcagcgagcttcgacccagcaggtgtttgagcggttgtcggatttagctgaagccttgattttgggggcgagggattggctgtttgagcagatgtgtggcgaatatggcacgccgatgaatgagcttggggaaaagcaagagttgctgattttgggtatgggtaaactgggggggcgagagctgaatttttcgtcggatatcgatctgatttttacctatcctgatgttggggaaacggtaggcggtaggaagccgatggaaaacagtaagtttttcactcgtttaggacagcggttgatccgagcgttagacgaaattacccttgatggctttgtttatcgaacagatatgcgactgcgtccttttggggatagcggtgctttggtgctgagttttacggcgatggaggattattatcaagagcaggggcgtgattgggaacgctatgcgatgattaaggcgaaaattttaggcgaagatctgacgaacattaaccataagtatttgaagcagatgttgcgtccttttgtctatcgtcgttatttggattttagtgcgatccagtcgttgcgagagatgaagcagaaaattagtcgtgaggtgttacggcgagagctggtagataacattaagctgggggctggtggtattcgtgaggtggaatttattgtgcaaacctttcagatgatgcgaggggggcgagataaaattttacagcaacgaagtttgttggcagtgttgccacagttggctcagttgaatttgttgagcgaaacacaggtaaataatttgcgtgaggcgtatctatttttgcgacacacagaaaatgtgttgcaggcaattaatgatcaacagacacaaaccttgccgacaaatgaagtggatcgggcaaggttggcggttgcaaatggggcaatggattgggaaagctttttattgcaactacatcaacaccagcagaatgttcgagcgatttttaatgaattgattggtgaggacggcagtgaggaaagcggtgaggaaaacccaaaatttgccgaatggcgagatattttaaatgtacaacttacccaagaggatttagctactgttcttgcgacctatcctgtagcaactcaagctcatagggagatctaccaacagcttataaccactctacaagagtgggtgaaacgcccgattggagtgagagggcgagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgctacagaagctgatgccgaaagtgttggatcagatttttcacgaggcggattatttactgttattgccacgcattttgaagatcgtagataaaatcaccttgcgtaccacttaccttgaattgttgttagaaaaagagcagattttgcctcaactattgcaactgtgtgggcaatcaataatgttagcagagcaaattgcacgttatccgatgttgcttgatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttttcagcaaagtttaatgacgatcttaccgcttgaggcttatcctcaagccttgcgagagtatttgttgcgtatcccagaggacgacgaagaagcattgattgacgggttacgccagtttaaacagagccatttattgcgtattgcaggggcagatattttgggggtattgcccgtaatgaaaatcagcgatcacctaacctatctggcagaagctattatcggggaagtggtgaatttagcgtggcgacaagtggcacagcggttcggtgagcctgaacatttacaaaacggcgagaaagattttgtggtgattgcttatggcaagttagggggaattgaacttggttataattcagatttggatctggtgtttttacataatgcccctgaacagagcgaaacagttggcggaaaaaaatccatttcgagccatcagttttatcttaagttagcccaaaaaattaatggtatttttaacttgaataccagtgcgggtgtgctttatgaagtagatatgcgactacgaccttctggggaagcagggttgttggtgagtacatttaatgcttacaaccactatcagaaacacgaggcgtggacgtgggaaagtcaagcccttgtgcgaactcgtgcagtatatggtactgcggaacttcgacaaaaatttgagcaaattcggcgagaaacgttaagccaagagcgttcaagcggtcagttacgagaagatattcgcaatatgcgagaaaaaatgtaccaccatctgagtaaaactaccgcagggcggttttatttaaaaaccgatcaaggtgggatcacggatattgaatttattgctcagtatcttgtgttaaactatacccatcaatatccacaaatggcggattggtcggacaatgttcgtatttttgaacgagcggtggattgtggtattttgactgcagatgaaggtgaacgattgaaagggtgttatactggtttacgcgatcaaattcatcgtttaaatttattgaataaagagagtattgttgatgccagcgaatttattgatgaacgtcagtatgtagcaacttgttggcaacgatttttgatgtaagagtgagggatttaaaatgaattacaataatgaatgtctttccatgttaaaactaggaaaaaaaacagagtataaaagtacttatgatcctagtttgttacaagcggtacctcgttatttaaatagagagagtttaggtattgttaaacagcaaccttttacggtaggagcagatatttggactctctatgaactttcatggcttaatcaaaatggagtgccccaagtagcaattgcagatgttattattgatagtagtagttcaaatataattgagtcaaaaagttttaaactttatttgaatagttttaatcaaatgcgttttccttcaagagaagatgtacaaagacgtattcagtctgatttaagtaaatgtgcccaaggagatgtcacagtgcaaatttataaattatctgattttgctatgcgatcaatttctgagtttaatggagaatgtatagataatcaaaacatctgtattaatcgttatgattttacaagagagtccttacaaggtattgcaaatggggaaattgtagaagagagattagtaagtcatttattgaaatctaattgtttgattacttctcaaccagattggggaagtattcaaatttgttatgtagggaagcaattagatagagagaaattgctgcgttatttagtttcgttcagagaacataacgaatttcatgagcaatgtgttgaacgaattttttgtgatttaatggaatttgctcagcctcaaaagttgactgtatatgctcgttatacgcgtcgtggagggctagatattaatccttttcgctcaaattttgaaggaataccagaaaatttaagaatggtgagacaataatgtatgtagatgatgattgctgtaattattgttttttgcaaatagccttagtccctctaaaaagaagtgatagaatggagtttttagaacaatccgctagaaaggtcttcaaatggaaaataaaaaactaacaaaagccttagacgctattgatttaaaaatcctaaatgaattacaacgtaatggtaaaatttcaaacattgaactctctaaacgtgttgggctttcgccaacgccttgtttggagcgtgtgaaacgtttagaaaaacagaatgtcataatggggtatcgtgctttacttaatccagaattattagaagcccctttgctcgtgattgtagaaattactcttgttcgtggtaaacctgatgtctttgaggaatttaatcgggcggtgcagcaacttgatgaaattcaagagtgtcatttagtgtcaggggattttgactatttgctcaaaacccgtgtggctgatatggcggcgtatcgtaaattattgggaacgacgttgttgcgtttaccgggggtgaacgacactcgtacctatgtggtgatggaagaagtgaagcaaactaactatctacttttgaaataaggattagctgtgattgatcgtttaaaagggaaagagaacctgattagattagtgttgttgctttcggcgtgttttgggatttatctgatcacggcgtgggcgagttatagtccgttggataatgcttggagtacggcaagttctattacccacgaaacattaaataaaacaggggcattgggggcgtatttagttgatttgctctttgcgatgtttggtaaagttgcggtatttgttccttttgggctggcatttacgtcgatttatgtattgattttacggttagctgacgatctaaactgggcgaaaattgggttttggctagggagctttttcttatttttagtcgggctggcggggttgtcgagcgtattgtttgaaaattccccttactatctttcgggtggttttattgggggaatgttagcgtcttggctcaattctcaaatggtattgttgctcgttgcaatgctattaacggcggtaggtttctatttttgttcgggacagattttgttgcaattatttaaccgcttgtatcattggatcgtggaaggaaaaaccgaagataagccgagtacgttaaatactgacgaggctgttcaaacagaggaaaatgaggagaaagtcgaagcggagagtgaaagcgaagaaaccgtagataacccacaatacacagatgtttctcagtttactcgtccgcatattacgggcttgaaaaccgttcaagaggaagaagtcgcagctgacgttgaattaaccgatgtaacaaaatttaaagtggagaacccaagttcgttgccaaacattagggtgccggagcttgatgttgcagttccttctgtatcaacttcctttgagtcgccggaagaaacagtgattatgccaaacgttactgagccggtaatgccaaaggtgcgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccaaaggtgcgtttaaaccctgtggtggaagtggcggcagagcctacagtagagccgtttgaagaagcacaatcaactgtgcaatttttacaagaaaacctaccgctatttgaacctaaagcagcaacagcagaggcacaacctgaaaagaagggtgtaacttatccgaaaggttatggcgatagccttattcacccgttgttacaaactaagagaaaggtcgaaaagccaaccacgccgttgccaacgattgatttattgacgacagtaaaatcagaagaacagcaaattacggagcaagaaattcgagatacctcagctcgaattgagcgtgaattagcgaactttggggtgagggcaacggtggaagatgtgttggtaggccctgtggtgacacgctatgaaatcaaaccggcagcaggcgtgaaagcggcgaagattaccaatttagcttcagatcttgcacgttcgctgatttttgaagccattcgtattacagatgttgtccccggcaaaccttatatgggaattgaaacccctaaccgtcagcgtgaaacagtttggttgcgtgatgtgctggatagcaatgagtttcgccataccaaagcgacattgccgatggcattaggaaaagacatcagcggcaagccgattgtggtcgatatggcaaaaatgccgcatttactggtcgcagggcagacggggggcggaaaatcggtcggagtaaacacgatgattttaagcctattgttcaagctatcgcctgagcaggttcgcttcattatgatcgacccgaaagtagttgaactgtcgatttacaacgatattccgcatttgctgaccccggtggtgacggatatgaaaaaagccgaaaatgcgttgcgttgggcggtggaggagatggagcgccgttacctactggtgagtagtttaaatgtccgaaacattgaggggtttaatgcgaaaatcgatcaagcggcagcaatggatctgcctattccaaatccgttgtggcgacctggcgatacaatggatagtttgccaccaccgttagaaaaattaagctacattgtgttgattgtcgatgagtttgcggatctaatgatgtcggcaggtaaacaggtggaagatcacattatgcggatcgcccaaaaagcacgagcggtcggtattcacttaattttagcgacacaacgtccatcaactgatgtgattactggggtgatcaaagcaaatatcccaagccgtattgcatttacggtggcaagccaaattgactctcgaaccattttagataaaggcggagcagaatctctattagggcgaggggatatgctatattctggggcaggtagccctgaaatgatccgtgttcacggggcatttatgaccgatgaagatgttcagcgtgtggcggataactggagagcgagaggtaaaccagaatatattgaaagcattgtggcaacaccagagggtgatgaaaatggcgaaaactcagaacgcacaagcggtgagttagatccactgtttgacgaaattgctcaatttatgattgacggtggggcaacctcaattagtggcgtacaacgtcgcttctcactaggctttaaccgtgcagcgagaattattgatcaactagaagaacaggggattatttctgctccagatagtcgaggcaagcgagaagtgctggcgagataaaggtgtttggagtatttgacaaacctatggcattcttttactttagaaagaataacaattatataacataaggatttatagcaatgagcaataaagtgggcaacacaatgtataaaaatgatgatgttcgtattaaccatattgaagaactgttaccaccagtggcactattagagcgttttcccgcaagtgatgttgcagcggaaacagtcgcgaccgctcgtgaagcagttcatcgtattttacacggagcagatgaccgcttgttagtggtgatcgggccttgttctattcacgacccgaaagccgcattagcatatgcgaaaaaaattcaagaaatgcgtgcaaatccgtatattaatcaacatcttgaagtaattatgcgcgtctattttgaaaaaccacgcaccactgtgggttggaaagggcttattaacgatccttacctaaacgaaacttttgcactaaacgacggcttgcgtattgctcgcaaagtgttatcggatattaatgatttaaccgtaccagctgcaggggaatttttagatatgatcaccccgcaatatgttgcagactttatgagctggggagcgattggtgcaagaacaaccgaatcacaagttcaccgtgaacttgcatctggcttatcttgtgctgtaggctttaaaaatggaacaaatggtggcgtgaagattgccttagatgcgatcggcgcagcagaagcccctcaccactttttatccgtaactaagttcgggcattccgcgattgtttcaacagcgggtaatccagattgtcacattattttgcgtggcggtgataatggcacaaattatgatgcggactctattgcaaaagtgtgtgtggatatcgaaaaatctggtcgccgtccgcacgttatgattgatttcagccacgcaaatagccaaaaacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaatgatgtggcacaacaaattgcgaacggctcacaccttatttcaggggtaatgatcgaaagtcaccttgttgaaggtcgccaagatttagttgaaggtaaagaattggtttacggacagagtattaccgatggctgtattggctgggaggacagtgaaaaagtgctattccaacttgctgatgcggtagcaaaacgccgtcaattaggcaaataattggtattatgtcgtctcgcttttttcaagcgagttcaacattattttctttatatgacattatgaacaaaactattttagcactagatactgccactgaagcctgctcagtggctttgttacatcaaggtaaaaccacatttattgatgaattaagtccaagaacccatactcaacgcattctgccgatggtagatgaattgctgacacaagcggggatttctgtgcaacagattgatgttctcgctttcggaagaggtcctgggagttttacgggggtgcgtgttggcgttgggatcgctcaggggttagctcttggtgccgaattacctgttgtaccagtatctaatttactgacaatggcggaagaggcttatcaaaccttgaatgctaacagtgtgattgcattaatagatgctcgaatgaatgaggtctattttgcacaatttgaacgaacagaacagggctggcaaactcaggttgtagagcaagtctgttcgccagaaaaagcaattgctcaaatgcaacnnnnnnaaaatacggttattgtaggaacaggctgggcagcctatccacaatttgagcaggctaacctcgctgtcaaagtaacggagattaccttaccatcagcaaaatatatgttatctttggcaattgagaaggttgtacaaggaaaagtacagtcggcgtttgatattgaacctgtttatttgagaaatgaagtgacttggcaaaagttgccgcataagttgtaggtatattatgttgaaaattgcgaataaatttatttcttcttctatttcaatggcttttttgggggtaactgggtggtcggttgcttatgcctatggttgggggcagtcatacttttatggtttcccttggtggtatgttgatgtgggaattagtaatgttgctagaagtttaggatatgtgctttggaatacggctattttatttcttacttatttaattggattatatattctaataaaagctaagaaatatatgccggaaccgtatattcaatttttacgagcatatattttgatttgcatagggctaagtcctcttctatttggctatattgcttcaataggaagatgtaacacttatgtcggattaggttatttattattgatattattatttactttaatatttaagaactatataaatcataatattccaagtatttctgttaaagcaactatgcaatttttatataaaaatcaggtgtatataattatctgtacatattgctgttttgtaatgtttgcttttataacgggttatattcgtcctaattttaaaaatacttttgatataatagatattgatcataaaacctattatatattggcaaaatataacgatacttttattttagctaatgagatatatgcaaataatgataatttttatatttataaattatcacctaattcgttatttcatataaaagtagtgaaggtatctacatctaaatgatgtacttgtacatcaaagaataggggcagtaaatttaaaatgttgatggactaattttacaaaggcatagtagacaagtttgttgctaatgtttgttttctttaaacattagcaaccctttttatttggcatagtagacaaaannnnnnnnaatttcgtgaaaactatgccttttatttaaaaaaatcttgtataaacaacatcttacatcatttggaatggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatgaatattttgaatcaaacttartgaatctgctcctccagatgaaagagcatgaatactaaagaaagcatcrtyatcaatacgaatrcctatggctggacgagargttaatacactrgaacyrgarttaatcacrwayacttcgcttgccatacgacgagcaataatcgcaagattaactcgatttgcccccacatctaagcgagagtaatagatataaacattatttggacgacttcttgtccctaagttccatacatattcatcaatcggaaagccaaccccctcaggctgaaccattcggcgtgtatgaacggctgttgatggcaaagagcctgcttcttgaaccattaaaatacctgccgcttgaggccccgtcaaaagctgacgaacattgatattccatttactttcattaatcgcagaagaaccttgcaagttccacgttgcaaccgtatagttttccaaatttgccaaggcaatttgaggaagtaaacaacatactaatgctatagctcgattaaataacgtcatttttcctcctataatggattagcactaagtaatggtggtgtgagatagaacgtttgatcgtgtaacggtgtaatacgtttatcatcacaacgatccaaagtcagcgtaaaatagccagtggtactcaccgcattgtaagttaagcaacgttgttgagaaacacttttaatgaacaccgmtcctgtcgaggttggcagtaactcaaaatcttgatctaaattatttggatcacagctatcttgaatcacaccatttccataagcctgcatacaagatcccatctgctgattagtaaagcggaaatgttcttgacggaagctccgctcaattcgccaattacgcaatttgccaaaatcttgagaattaagyggcggatacatccaaagccagctacgacgatcaacagaccacatcgtaatcaccgccccattttgtcccataatgctgataaagtcgttaaattcggcagtatttgatggactggttgctaacaaattgascgttggtggrccaggcagttttaacagacttgttggtaaagggggcgtagggtttagcgtttcctcaaayaacgcctgatcatcttttttctcttcctgtggtttttgcgttttttcacaactacaactgcaaccaagtaaagcacttgtaaaaatagcaagtgaagttagatatgtgagctttctcatttatatctccttgtgataatttgagaaaatctatagtcaatgtttactttgatcaagaaaatttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgcttggcggatttctgccattaaacgttggtaataacgtaaattgtgaatggtgtttaatcttgcccctaaaatttcaccgcatttatcaaggtgatataggtaggctttggtgtagtttttacaggtgtagcaatcacattcaggatcaagcggtgagatgtcattgcgatatttcgcattgcggattttgacaataccgttggtgacgaataagtgtccgttgcgagcgttgcgagttggcattacacagtcgaacatatcgatcccacggcgaacaccttccaccagatcttcaggtttgcctacgcccattaagtagcgtggtttatccgcagggatttgtgggcaaacatattctaaaatgcggtgcatatcttctttcggttcgccaacggctaaaccgcccaccgcatagccgtcaaagccgatttcaaccagtttttctacggaaactttacgcaattcttcataaacgcccccttgaataatgccgaataacgcattcgggttttgtagttcgtcaaagcgatcacgactgcgttttgcccaacgtagcgacatttccattgactgttttgcatagtcaaaggtcgctgggtatggagtacattcgtcgaaaatcatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacattcgtcgaaaatcatcacaatatccgagccgagatcgtactgaatttccatagatttttctggggataaaaagactttttcaccactaattgggttttggaaataaacgccttcttctttgattttgcgtaatttgcctaaactaaagacttggaaaccgccagagtccgtaagaattggaccgtgccattgcataaaatcgtgtaaatcgccgtgctgacgcataatctcttgccctgggcgtagccatagatggaaagtgttgccaagcagaatttgcgcgcctgtttgcgccacttcttcaggggtcattcctttaaccgtgccgtaagtcccaacgggcataaatgcaggggtttcaacgtgatattcgccctttggacgagaaaaagttaatcgaccacgacgagcgttgccgtttgttttttttagttcgtatttcatttttgttcctcaaataaacagtctgagtagaaaagaataagacgaatagatattcgccctacaaaataatttagtagggattaaatgtctaaatttgcatataaggcattattttcgataaaatcacgacgtggttctacttcatcacccattaatgttgtaaagagtttatctgctgcaattgcatcagtaatagtaacttgtaacatcttacgtgctacaggatccatcgttgtttcccaaagctgctcagggttcatttcacctaagcctttataacgttgaatggttaaacctttacgagattctttaaccaaccaatcaatggcttcggcaacactttctattgattgctggcgttcaccacgttgtacatacgctgtaggttcaaggagatcgcttacttgttcgcctaatttagtaatacgagtatattcattacttgtaataaaattgaaatccaaacagtaagttgtgctaattccgtgtgtagtaacaattacttgaggttcataaatatggcgttctgcattataaaatacctctgcaacataagtacttccactagtttctttagctgttaagatctcaacaattttgttattccaagcggtcacttcagtttcattttttacaaattctgtcgtgagggctggctgataaattaattcattcagtaaagcagttggataacgacgggctaaacgctcaaacaatttttgaacatcattatattcagcaattaatttctcaagtgctaagccatttaatgctggcgctttatcacttacgtaaagtgaagcaccatctaaggctaatgctaattcatattgctccatttccgtattatcttgaatatatttctcttgcttaccttttttcactttataaagtggtggctgtgcaatatagacataaccacgttcaattaattctggcatttgacgatagaagaatgtcaaaagcaaggtacggatgtgtgcaccatcgacgtccgcatcggtcataataataattttatgataacgcaatttctcaatgttatattcatcacgaccaatacctgcacctaatgcagtaattaacgtcgcaacttcttgtgaagaaagcattttgtcaaaacgtgccttttctacgtttaagatttttccttttaacggtaaaatcgcttggtttttacgatcacgcccttgttttgcggagccacctgcagaatccccctcaactaagtaaagttcagataatgcaggatctttctcttggcagtctgccaatttacccggtaacccccctaaatccaatgcgcctttacgacgagtcatttcacgagctttacgtgctgcttcacgggcacgggctgcatcaatgattttagtcacaatattttgagcatcatttggattttctaatagatattcctgtagtgcttcattcattgagctttccaatggatttctaacttcagaagaaactaatttatcttttgtttgagaagagaattttggatctggtactttcactgaaataacagcgactaaaccttcacgtgcatcatcacccgacgcatcaattttggcatcttctttttttagttttgcccctgtttccatatagtttttcaaggcacgggttaatgcaccacggaaacctgctaagtgcgtaccgccatcacgctgtggaatattattggtgaaacaatatacattttcgttaaaactatcattccattgcattgaaatttcaatgcctatatcatctttttctgttgaaagataaaatggcgttgggtgaattacgtttttaccttcattcaaatattcaacataagcacggataccaccctcatatttgaaatgttcttccttatcattacgttcatcaactaagcgaatcgatacacctgaatttaagaatgaaagttcacgtaagcgtttagataaaatcgcatattcaaattccgttttatttttgaaaatatcataactcggccagaaacggacggttgttcctgtcttttctgtttcgccaattactgctaaaggtgcatcaggatctcctaaactataaaattgttcgtgaacgtgaccttcacgacgaatagtcagttgaagtttggacgagagggcatttaccactgacaccccaaccccgtgcaagccgcctgatactttgtaagaattatcgtcaaacttaccgcctgcgtgtaatacggtcataataacttccgccgcagacactccttcttcagggtgaatccccacaggaatacctcgcccatcatcttgcacagacactgaattgtccgaatgaatagtcacgacaatatcattacagtaaccagctaaagcctcatcgattgcattgtccacaacttcaaaaaccatatggtgtaaacctgtgccgtcatcagtatctccgatatacatacccggacgcttacgtacagcatcaagaccacgtaatactttaatgctagaagaatcatagctatttggttgattttgttctgacattgttgttcctatattaacttaaattgacaacggcaaaatctgccgaaaattaggcaagattatatcagaaaagggaaaaagggggaaggaatcaaacgtactcaataggatttagccaaatcattaccacagtaggtcgcattatttttcagatagtaacacatttttatgattgaggcttaatttaggattatttactatatataatatccagtacatgtgatgatgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgatgatgtaatacttacacaaaaggataactatatgtacattttaactcctcaagaatttgtcacttgggacgaaccgattgaaatgctttatgcttgccacggaaaggtcaaaagtttctgccgtcagttacaactgttgccagattacttagcgaaaaacggggtaaatcaagcggtcaaaaatgatgtacagcagatcttaaattacttcaatcaatctgcacccttacaccacgatgacgaagaaaaagatttcttcccagcattgattaagcaacgcccagaagcgcaaacggacgtagatttgctcgaagcacaacacattgaattacatcaaaattgggacgaactctccgcccaattagtcgccttactcaatggcgaaattcaacacattgaccgcgagttaatccaacgctttgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatccaacgctttgtggtaggttacgatcaacatattacgattgaagaaccgctttttgaattagggcgagagcatctaagccaagaagaactcaactcaatcgggcagattatggcagagcgccgtcgggtttaatggtgaattattcacttgatctcaccgcttaccgttgccctcttcctcttttgtcggcaaaaaggggaatgttacagttgaatagcggagaaagtttgaaacttcattttaataaagacgttttattaaacgatattattttattatgccaagaaattcagtgcgagctcaaaagcaaaatagagtcagaaacagaagttattttattcatctataaagataaggcatagtagtaatactataccttattgtttatttaactgttgctaccatcatcaccatcataaaactgacgacagcaagaatgaaatgtttgagagaaaaaggttgctctttcttgaaggcttttgtcgcataataaatatacatcaccaaaaagaataacttcgctaaaatccacgtttgaaaatccatggcgaaatagacaaaaatgcccacaccagacagtaataacaagctatcaacagcgtgtggtgcaatttttaagagtttatattgtcgccaatcaaccattcttgcggaaagtaatccgcgaaccagtaatagcattaagcttaggtaagctaaaccaatatgagtataaaagatcgtttgcattaattttgtccttatttaattttgttcaataattgtagattttaaatattgaaaaatttcacgataatttttcggtggtttatttgcttgcttctctttctgtgcggcacggattaaattgcgtaaatgctgacgatccaatgtcggatattcatctacaagcggattgatcgcactgtcgccttgttcaacgagttcatctcgaattaactctaatttgtgcaatagggcttgttgctgattatggcgattttcaactttatccaatgcttcctgaataggttcgtgatcgacattgcgtagcaattttccgatatattgaatttgacggcgacgagcttctaaacgtaagcgttgcgctaactcaattgcttcacgcaaggtatcatcaataggcattttagcaagattagcactattcagttctatcaaacttgcccctaattttttaagatgttccgcatcacgtttaatttcacttttacttacccagatgatctcctcttcttcatctgtccaatcaatctcattacgttgttttttagccattgctattcctttcttttacacaatttgcgtagtttatcagaaatttagggtagaatggcgagattaagtgaaaagagaacagttttacaaaaattttcgctaatcctaccgcttatagaaggaaaattatgtcatttattaccaaacaagaacttcaagctcaagaacaaaccttacgtcaagccgttgaaattgcactggatttagcccaaaaagcgggtgcaacggcagaagtgggcgtaaccaaagttgcaggcttatcagtttctacacgcttagaacaaacagaaaatattgaatttaacaacgacggctcactcggtatttctgtctatctcggtaaacgaaagggcaatgcttcaacttccgatttgcaaccaaaatctattcaacaagcggttgaatcggcacttgcaattgcaaaatatacctcagaggacgactgtgcaggtttagccgataaaaaaatgatggcataccaagcccccgatttggcgttatatcatcaagcagacattaccgttgatcaagcggttgaactggctattgaagcggaacactatgcactacacagcgatgatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattgtcaatagcgaaggggcaaccttcaattcacacgcaggcattagagtttatggcaacacacacggtatgctacaaagctacctatctagccgatattccctctcttgtagcgtcatttcagcctatgaagatcagttagagcgagattacgaatacactatctctcgtcaatttgaccaacttgcctcgccaaaatgggttgggcaacaagctgcagtcaaagccgttgatcgcctaaaccctcaaaaactggcaacctgtgaagttcctgtgattttttataacgacattgccacagggcttatcggacacctcgcaggtgcaattagtggcggagctttataccgcaaagccagcttcttacaagacaagttaggtgagcaaattttgccgacttggtttgaaattaacgaaaaaccgcatctacttcgccaacttgcttcatcaccttttgacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgaaggcgtttacactcgcgatcaccaaatcattaaagatggcgcattacagacctatcttttaacgacatacagtgctaaaaaattaggtatgcaaacgacaggacacgcaggcggtattcacaactggctagtcaaacctaatcgcacagggggattaactgcattacttaaagagatgggaacaggtttacttgtcaccgaaatgttaggcagtgcgattaatgtcgtgactggagaatattcacggggagctgcaggtttttgggttgaaaatggcgaaatacaatatcctgttgcagaaattaccattgcaggacagctacaagagatgtttaaaaatatcgttgctgttggtgatgatattgaacatcgttcgaatattcagacaggttcaattttattggaaaaattgaaagtgtcgggagaataaaacgatgaaaattatcttcaggctgtagtaatatatgcataaactttttatacagtaggaagaccaagtgtggcgttcctactgttctttctttggttcaaagctacataatactggaaaactgattaacataatgtaaatacatgtttcatgtgcttgactcatggtaatagttatttttgtatataaggcaaaaatagagcagtaaagttttaaggtacgacaatgattgtaacgataaaagatcttgctaaagaagcagggggttctttatgtacggtttctaaatgtgctaaatggcaagagtggcgtaagtttagacaaaattgaaaaagtacagcgtgcgattgaaaaattagtctaccaacgcaatatgcaagcggctcagttaaaacggggcgtaagcaataaaattgcgattattctgccaaatattattgatgtaaaatatagtagcctgtatgaaaatctgaatgcagactttcagcaagataattttatttttgaactttatctcacttataatcaggaagaaaaagagcaagaaattataaaacggattaaagaagaaaattatctttctttagaaacattatcgaactatttttcaagcaatgttcttcacagtttttgccaatttcaacaaaaaatttattaggttccctttgatccaagttttctgatgcttttttatcgtaaagatttatttgaagatcctaaaatcaagcggttgctgaaagtttatcacagctaaaaactttatatcatcattcgattttattagaaaaatgttggtggaaagaagaagtaaaattatttgaacaagggaaaattccgttgttaattgtctatatgaaccactttagcacagattgagcgagagattggggtgttgaatgggtagaaacacggcgtgttcttatcatttaattattcgtaaaagctgattctcagcagagacaggcatagtagacaaacttgtctactatgccccacaaaatggtgtaatagacaaaactgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaactgccaccaataattgtagacgttttaaacagaaaaacttatctgcaactaacgcaaaaacgcaggaattttgctttcgtaagctgcaattttttcttcgtgttgcaaagttaaaccgatattgtctaaaccatttaacaagcagtgacgacggaaactgtcgatttcaaaagagtaggtttttccatttgccgaaaccgtttgagcttctaaatcgacggtaatggtcgcaccttcatttgcttcgacatatttgaaaagttcatcaacttcttcttcgcttaaacgtacaggcaacatttggttatttaaactgttgccatagaaaatatccgcaaaacttggggcgataatagcacgaatgccgtaatcatctaacgcccaaggtgcgtgttcacgggaagacccacaaccaaagttttcacgagccaataaaatgcttgccccttgataacgtggaaaatttagcacgaaatcaggatttggctgtttaccttcatcatctaaaaaacgccattcgtggaataagtgagcgccaaagccgacacgggtcactttttgtaagaattgctttggaataattgcatcggtatcaacgtgcgaagcatcaagtggaactgctaaaccagtatgttgtttaaattcttttgccattttcttattccttagtgtaattctacgttgcgaatatcgacgaatttgccgtgaacagctgccgcagccgccattgcagggctaaccaagtgagtacgtccgccacgaccttgacggccttcaaagttacggttactggttgaagcacagcgttcacctggctctaaacggtcattgttcattgccaaacacattgagcaacctggttgtcgccactcaaagcctgcttcaataaagattttatctaaaccttctttttccgcttgttcacgcactaagcctgaacctggtaccactaaggcttgaacaccatcagcgactttgcgtccttttgccacagccgccgctgcacgcaaatcttcgatacgagagttggtgcaagagccgataaatactttgtcgatagccacatcagtcaatttaatactgtgcggtaagcccatataagctaaggctttttccgccgattgacgctcaatcggatctgccatatccgcagggttcgggatcgtttcattgataccgataacgtgtcctgggtttgttccccaagtcacttgtggctcaatctcactggcttctaaagtgaccacagtatcaaattctgctccttcgtccgtgtgcaaggttttccaataagcgactgcatcgtcccaatccttaccttttggtgcagacggacgatcttttaaataagcaaaagtggtttcatctggtgcaattaaacctgattttgcaccaagctcaatcgccatattacacacggtcatacgaccttccatagataaatcacggatcgcttcgccacagaactcaacaacgtgtcctgtaccgccagccatcgtagttttaccgataatggcaagcacaatatctttcgccgtaatgccttcacgcactttgccacgcacttcaattttcatttttttcgcacgggcttgttttaccgtttgagttgcaagaacgtgttcaacttctgatgtaccgataccaaacgccaatgcaccaaatgccccgtgtgtcgccgtatgagagtcgccacacacaatggtcatacctggaagggttaaaccctgctcaggccccataacgtgcacaatcccttgattaatatggttaatatcataaagggttacgccaaactgctcggtattttttgccagctcaaccatctgaatacgccccatttcgcctgaaccacctaaatcacggctatcggtaggtacgttatgatccattgttgccaccgttttggttggctgacgcacttcacgccccatcgcacgcaaaccgtcaaaggcttgtggtgaagtcacttcgtgaaccaaatggcgattgatataaattagaggtgtttcaccttcagcttcgtgaacaacgtgagcatcaaataatttttcgtataaggtttttttcataagtccaactctcaaatgcaaggggacaagcggggggatcacataaaaaattaccacaacatttcaatatggaacataaacgtggggacacactgcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacacactacgtgtgtccctacatcttgttaaaacttcttacaaatccaaccgcttgtaaaagaatgatttggaatatatcgctactcaaaacaaaagtaaaatgctatttttgggaaaattgcatttttttattctgtgaaataggttttaagttggcatattaagtgatatgttagcatattatgctaaatcttcttgtttttatggttttaagatttaatgctttggatttattaggatttttatcaatcgaaaaaagattatctgtttttatgaattaataggcaaaagtcattgaagttgctgatttctacaagagagaaaataataggcaataaatccaactaccgtacaagccgccatcgtatagagcattggacgctcgctggttagcggaatatgggataatcctgccccaactaatgaaccaatcccaaagcgagcagtaccagctacggcattggcggtacctgccatttgtggatagcgatctaaaatagccgcagaagcattactaccaatggtcgaaaccattccaacaaaaaatgccacgccaattgccattgaccacaaacctaattgcaatgttgcagaaataatcagccaaatacccgctagaagttgtaagcttattccaatgcgtaacattttttctgagccgattttggtgacaagtcgtccgttgataaaggtcatcaccatcatcacagctatatttagcataaaaaagtagccaaagtattcagatgaaaccccataaagcccaatataaaccagcgagccagaagtaagaaagcaaaacattcctgcaaaggacattccaccaacgagaacatatcctaacgttgctttatgggaaatcaatgtcgtaaaattttgtagtacttgacgaaaactcaacggcattcgattttctgtactcaaggtttcaggaataagcgttgctactaaacaaacgcagacaatccccatcaccattaaaatataaaaaatagcatgccaatgtagccacttcgctacatatccgcctaaaataggcgctacaagcggtgcgatcatcgtaataatcataatggtggacattaatcgggcaaactggttgcgatcgaatatatctcgcactaaagccccaagtaccactgcaggtgcagctccaaataagccttgtaatagacgcaatagatagaaattttcaatactcaatacttgcgttaagaaaaaagctgcgacagccccgccagataagccaagtaaaataatcggtttacgtccgaaactatcggcaattggtccccaaaaaagttgcccaattgcaaagccgaaagtaaaaatcgcaagagttgtttgcaccttttcttgagatactgacagatcttgggcaatatcaagaaaagatggcagatacatatcaattgcaagcggtggcaacattgagagtaatcccataatcactacaaataacccgttgggtctggttattttattcatttaaaaactcgctatttcatcttcagttaaagctctaaattccccttcagcaagattttcatcaagtaccacatcaccaattcgccaacggtgcaacgcaacgactttgtttccaagagccgcaaacatacgtttgacttgatggtaacgcccctcgctgatagttagattaacgttgtaatcatctaaaatttcaagtttagccggctttgttgctgttttttcaccacgcaataaaatgccttcggcaaattgcgtggcataaaaatcttccacgggatcagcaagggtaactaagtaggttttttcacaatgatgtttgggggaagtaatgcggtgtgaccattgtccatcatcggtcaataaaactaagcctgttgtgtcagcatctaaacgccccgcacaatgtaattttgtggtaagtggatagtcaaaaaattggaataccgtcgggtagtcgccatcatcgtgagagcaaacacaattttgtggtttatacagcataaaatattgcccttcatcaacccaagctagtggttcgccatcaaaacagatctcatcttgctcactgattttggttgcactatttttttcaaccacaccattaactgtgacttgcccggctcgtaacgctttactggcctgagagcgagtaagcccagtgttttctgctataaatttatctaaacgcatgttttacctgaaaattgaataaagtgcgacattatatctacattttcataacaaggttaaagatattgacaatatgttgatattattccacccacaacggcaattgcattttgacgcgtaatccgcctaatgggcttttttctgctctaactgaaccgtgatgttgtcgtattgcattggcaacaatagataaaccaagccctgttccccccgtttgtcttgctctgtcttcttgaacacgatagaacggacggaatatctctttatattgatcttctggaacaccttctccatcatcatcaacaagaatataaagatcgctggcatcaatgtaaaacatcacttttacggttgtttgagcatatttttttgcgttgcgaatgacattttcgacggcactagctaacaatacaacattgccatttacaaagtaacgctcagggtggaggatacgttggcttacgactaaatcaaatccactttgttccaattcaaatttggcatcatttaatacatcgtcccatattttatggattggaaagacttttcgctctagatggtgattagcttgtttacgagataaaaccaataaatcgtgaatcattgtgtccagttttgtaatttcaccttcaatacgagtaatttcactgctttcaccatttcgacgaagcaagagagataaagctaattgcattcgagtcaaaggggtttttaattcgtgcgaaatatcagataagaggcgatgctgatagttggttagtcgttctaatgcgacaatcatttcattaaaacttgctcctacttgacggagttcttcaatgcctgaggtttctaatttgggattgatggctaagtttcctcgtgctactgcatttgcggttaaacgcagttcttttactggtttggcaatgcggtacgatagccagatcatcactgggctactgacaaaaagaagtaaaagtagcattatccaaggcgagtcaaataatgtattaatgagctctcgttgagggttcacttttttagtgaaatagaggtcgtaagtgcgagtgtgagaacttgcaagaaaagggccgtaaaattccattgtgccgaagcgtctttgtaatggttggaggtgattttttgccttatatataaaagcgtggaaagcttcattattttcctctcttattcctgctaattgttgtgaggcgtgatcaaagaggataatgtcaaaaccattaatagatgctacagagagattgtggcgaaacacttcgtctaaattatattcttgttctacatatttggtttcgtgctgtaaaaagcctaattgaaaatcgtcaatttgcttgaaacgacgagtatctaaacttggcagtaaaatagcaagtgccaaaataatggcaataataaccataaaagaagcaaaaatttgataggccaaatatcttcggaaatttcttagctttaacataacggctcacttatagatagaaaaatcccccaaccatataaaaagctgagggattttactttatgatgattatttttcagtcaccagtaaataaccacgaccacgtaaggttttaaaccatggaaggttatcattacgctcaggaagttttttacgcaaattagaaatatgcatatcaatcgctctgtcgtatggcgttaaacgtttacctaaaatctcaaggcttaagagttcgcgtaaaagaatttgtccggggttacgcattaaaatttgtaatagtgcaaattccgtaccggtgagatctaaatcttttccttcgtaaatcgcttgttggcgaccagggtgaagctcaacgccaccaaattgtaacagttttcggtcgtcatcatcattcacaatgaaagcggtttcaactggcatacttggtttctgcgttattgatctgcgtaagatagcttttatgcgtgcaaccaactctctatcgttaaacggttttggcaggtaatcatctgcaccaagttctaaaccaagtacacggtcgatttcatcatctcttgcacttaacataagaactggggttgagtatttttgacgaacctgttttaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgttttaaggtttcaataccattgagaattggcatcatgacatcaagtagaatgagatcgtaactctgtatctttaattcagttaaggcatcctgaccattgtgtacagtatgaatatcaaagccttcaagagagagtaattctgaaagtaattcagttaaatctacatcatcgtcaacaagtaaaatttttggcatagctctatttccctattccattgatcatttcttgactatttacataaattatctttacataaacagatctatagtattactttacctaattttgtcaatttattctactttttttatttcattccatagaaaatctagttcagataatgtgcagtcttgcggttttttcccttgataaatcagatggttctcaatttttctaaagcgattttcaaattttacatttgcatggcgaagtgcagtttctgcgtcaattttgtgatgacggcataaattgaccattgcaaataataaatcgcctaattcttctgctaatttttccggttgctgttgttgaatttcttcttgcacttcagccaattcttcttccactttggcaaagacatcttgcggattatcccagtcaaaaccgactttggcacaacgcttttgcagtttgtctgcacgagtaagggcaggcagagcaaaaggcagatcatctaatatagacgtttgctgtttcgcttctttctctttggctttttgtgcttcccagttttgtagtgcttcttcactgttagtggcagtggtatctccgaaaacgtgtgggtggcgataaattaatttgtcgtgaatatcgtttagaacatcttgaaagctaaaggttccttcttctttagctaattggctaagaaataccacttgtagcaacagatcgcctaattcttcacgcaaagcggtacgatttttagtataaattgcttccgccacttcataggtttcttctaataaattaggaagcattgtgtcgaaggtctgtttaatatcccaaggacagcctgtttctttatcgcgtaaacgctcaacgatgtctaaaaattgctgaatagttgccatagtgttttcctcaaaaagcgtatttgcgagcttttaaaaaataattaaagattgaaagaaaccgttttgcctgttgttatgtatagcatttaaacaaaagatatagtagggacgccacgcttggtgtccaatatcaatataatttttacaaatatcaatatcgtagggacacactgagtgtgtccgcccgtaaagtaaggttaaatgaaacagacgccaagcgtggcgtccctacggacactttaaatggttcattttttatttacggacacacgcagtgtgtnnnnnnnnnnnnnnnntatattttgggtgttttatggattgtaatcaacggctttttcaagcgcaatgtgagatttcagtcaagttaatctgttaaaacagttggaaacagtattagcatttgtcaatttcagtgaagataggtatgcttgtaacgttcaaaaatcgattttaaggaatggttatggatctcgcttatttacaaaaactcccccaagaagaatttcacactcgtcgtcagcgtttgtttgaacaaatgcaagacaactcaaccttgattgtctttaccgaaacagaaaaacgccgtaataacgactgcgactatttattccgtccagatagctatttttggtatctcacgggatttgctgaacctaaatcagcgttagtgttgctgaaaaaagcagggcagtgtgagagcttgatttttttacgcaaaaaagatccgctaatggaaacgtggaacggtcgccgtttaggtattgaagttgcaccacagacgttaaacgtcgatcaagcctacgatatcgaagatattcaaaccattcttgcagaaaaatggacagatttgaccgcttgttactatgcaagaaatgtgcaaacgtggggcgatcagattgtttttgcaacctttgatgccatcactgcaagccgtaaaaaagccccaacaactttgattgattggcaaccgatactctctgaaatgcgattgttcaaatctgaagccgaaattgccttattacaacaagcctgccaaatttcagcctttgggcatttacgagcaatgaaacaaactcgcccaaatcgttacgaaatggaaatcgaaggagaaattcaatacgaattttctcgttttggctctcgctttgcgtcctataatcaaattattgcagggggcaataatgcgtgcattttgcactataatgagaacgatcaagtgttaaaagatggtgatttactgctaattgatgcaggggcagagtttgcaatgtatgcaggcgacatcacccgaactattcctattaatggtaaattttctacggctcagaaagaggtgtatgaaattgtattggaagccttaaaagaagcgactaaactgcttgtaccgcaaagctcgatcaaactggctaacgataaagcagtgcgtattatgacagaaggaatggtacgtttaggcatattaaaaggcaatgttgatgagttaattgagaataaagcctaccgacaattttatatgcacggcttaggacattggctaggcttagatgtccacgatgtcggcgactatggcaatgaacgagatcgaccgcttgaaatcggtatggtgctgaccgttgagcctggattatatatcccgaaagatgccgatgttccagagcaatataaaggcattggtattcgaattgaagataatctcttaatcactgaatacggcaataaaaatctcacttcgggtgtgccgaaagagattgcggagattgaggcggtaatgggggaagcgacgaattaatctcttgaataagctagaaaataagactagactcacttatcggactaagaaaaaggggctgttatgctaaatcaatctttagaaagtgtgaatatgcacgaagcaaaaaccaatttttctcgcattgttgaagatgtgaaacgttttggaaagccgatcatcatcgcaaaatcaggtaaaccacaggttaaaattgtgcctttggatactatacaaaatggcagtcgctttggttttatgaaaaagcaaaatatgcaaattcctgaagattttgaccgcttgtatcaaaatgaaattgtggcaatgtttgaaggaaaagaggaatgaagatcttattagacagccatattttgctttggcttgcgtgggataaaaaagaaaacctatcgccacaagcggtggaattacttgatgacccgaccagtgaaatctattttagtttagcaagtttatgggaaattgcgattaaatctagtttaggtaaacctgattttgacattgatgtagaagccttagagcaaggcttaattcaggtaggttgtcgaatgctagctattgaattaccccatattctaaaacaagctcagtatccttttattcatcgagatccctttgatcgtctattaatggctcaggcggaagtagaaaatgtcttttttatgaccgcagatactatgattttgaagtatcagaaaccttatattatcgacgtgagaagctataaaaattgaaatttttgacagccccatatttccgctagaatgcaaagcaccattttttataagaggcaaacacaatgacacaagtttataatttcagtgcaggcccggcgatgatgccgactgccgtattagaaaaagcacaagcagaattgttgaattggcaaaatcaacacacttcagtaatggaagttagccatcgtggtaaattgtttatggaaatgatcgcagagtgtgaacaaaatttccgtaagctctataacattcctgaaaactacaaaattttattcctacaaggtggtgcaagagggcaatttgcggcaattccgatgaacttaatcggcgaaaaaggcaaagcgttatatttaaccggtggacattggtcggcgacagcggcgaaagaagctcgcaatttctgtgaaattgatgaaatcaatattttagagcaaggcgatgaactcaaggtgggtagccttgattttagcgagattgcagagcagtacgactatgttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttatgccggtgcgcaaaaaaatttagggccggcagggattacccttgtgattgtgcgtgaagacttgattggcaaggctcgcaaagcaacgccatctatttggaattacgaaacccaagctaacaacgattcaatgatcaacacaccaccaacatttgcttggtatctctgttcattggtattcaaacatctgcttgaactaggcggtttagctgaaattgaaaaacgcaatcaagctaaagcagaattactttatcgctaccttgataacagcaacttctaccgtaacactgttgctaaagcgaaccgttctttaatgaatgtcacctttaccacaggcaacgacgaactcaatgcaaaatttgtggcggaagcaaccgcttgcggtttacaagccttaaaaggtcacaaagtgttaggcggtatgcgtgcatcaatctacaacgcaatgccgattgaaggcgtgcaagcgttgattgcgtttatgcagaagtttgaggcagaaaataaataatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacggagatatagtataatgcacagcacagcacagcacagcacagcacagcacagcacatctggctgaaaatttagcnnnnnnnnnnnnnnatcaacaggcgtttcttaacaaactcgatgccgacctttggaaagccgccgataaacttcgccaacagcttgacgctgccaactacaaacacatcgttctcggtttaatcttcttaaaatacgtttccgacagtttctctgcacaacaagaaatcatcaaacaacgttacaccgacccaacttccgatttttatctcgatccgaccgcttacagcgaaagcgaacttaccgatattctcaatgccgaactggaagaacgggacaactacgcccaagacaacgtattctgggtgccgcaacaagcccgttgggacgaaatcaaagtcgttgtaggggcaaacattggcgacaaaatctggggcgagaaaacctttaaaggcattgccaacttgattgatgacgcttttgacgctatcgaacaagacaaccctaaactcaaaaacgtcattcaacgcatcagcccttataaagtcgatgaaagcattttattaggcttaatcgatctcttttccaataccaatttcatccgcccaaccctagacggcaagccgatttccttggaggcaaaagatattctcggtcacgtttatgagtattttctcggacaattcgcccttgcggaaggtaaaaagggcggtcaatatttcacgccaaaatccattgttaccctgattattgaaatgctcgaaccctacaaaggacgcatttacgacccagcaatggggtcgggcggcttttttgtgcaaacagaacgctttatccgcgaacatcaaggcaacgtcagcgaagtgagcattttcgggcaagagttcaacccaaccacttggaaacttgccgcaatgaatatggctatccgtggcattgaatttgacttcggcaaaggcaacgccgacaccttcagcaatccgcaacaccgtgataaaaaaatggattttgtgatggcaaacccaccgttcaatatgaaagactggtggaacgaaagccttgcccaagacccacgctggcaatacggcataccgcccgaaggcaacgccaactttgcgtggctacaacatatgatttaccacctttcgccaaacggacgaatggcgttgttgcttgccaacggctcaatgtcatcgaacaccaacaacgaaggcgaaatccgcaaaaatattctcaaagccgatcttgtggaagcgatgatcgccctgccaagccaactctttaccaacacccaaattccagcctgtatctggatcctaaacaaaaacaaagcacgcaaaggcgaagtgctgtttattgacgcacgacaactcggctatatgaaagaccgtgttttacgcgacttcaccgcagacgacatcgccaaagtcgccgacacctatcacaactggcaacaatccgccgactaccaaaatatccctgcattctgctacaccgcaagccttgacgaaattgctcaaaacgacttcgtccttaccccagggcgttatgtcggtgccgccgagcaagaagatgacggcgtgccatttgcagaaaaaatgcaagaactgaccgctcttttacagcaacaatttaagcaaagtgcggagttggaagccaagattaaagcgaatttgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagatgagaaaattgcactcaacacccaaatcaaccaaaccctagaacaaatcgcccaaacgatttttaaaagctggtttattgattttgaccccgttcacgccaaagccaacgcactggcaagcggacaaaccttggagcaagccacccaagcggcaatggcagtgatcagtggtaaaaacacgcaagaattacaccgcttgcagacggcaaatcccgaacaataccaacaactatgggaaatcgcagaggcatttccgagtgggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaggaaaaaaacaatgctcatcaacgaaaacaccattgaacaagcctgtttgcgatttttgcaggaattgggttgggattatacgcacggttcgaccatcaatgccgatggggaaaatccttggcggttgcggacggacgaggtggtgtttcgttcggtgttgcgtgaggcggtggagcggttaaatccgcagttgccgtctgccacggtggacgaagtggtggcgttggtgtgcaaaacggatattacggatttaacggagcgtaatcagcaagcctatcgctatttgcgtgagggcgttcgggtggagtatcgggaaaatgatgagcaaaaggtggaatttgcccgtttgattgattttcaacagccaaacctgaaccgctttgatgtcgtgaaccagctgacgattttggggcggaagggtaatcgccgccctgatgtgatttgttatatcaatggcttgcctgtggtggtattggagctgaaaaatcccttgaaagagaatgcggatttgccacaggcgtttaatcagttgcagacgtataagcaggaaatcggcgatctgtttgtgtataaccaagcccttgtgatcagcgatggtattttggcgaaggtcggttcgctcacggcagatttggagcggtttaccccttggcgtgtggtggacgagaagaacaagcaacggatttcctttgaacacgagttggaaggcttggtgcgtggtttgcttaacccagtgagtttgttggattatatccaaaattttattgtgtttgagccgacatcaagcggtcgtttggtgaagaaaattgccgcttatcatcaattctacggcgtgaatgaagcggtggattgtacgttgtgggcggcaagcgagcagggcaatggcaaaatcggggtgatgtggcatacacaaggttcgggcaagtcgttgtcgatgttgttttatgcgggcaaattgttgtcgcaagcggagttacgcaatccgactattgtggtcgttaccgatcgcaatgatttggacggtcagctttatgccaccttttcaggcggtcaggcgttaattcgtcagcaacctgtgcaggcagacggcagggaggcgttgcgtgaagaacttgccaagcgtgaaacaggcggtgtgatttttaccactattcagaaattcggtttgcaagagggcgagcaggctcaccctgtgttaaacgagcgacacaatattattgtgatcagcgatgaggctcaccgttcgcaatatggttttagccaaagcatgaaactcaacgaagcaaatcgcacagggacataccgtgtcggctatgcaaaacatttgcgtgatgctttgccaaatgcctcttttattggctttaccggcacgccgattagtcttgaagataaagatacgcaggaagtgttcggtaaatatgtgtcgatttacgatattaccgatgcggtggaagatggggcgactgtgccgattatctatgaagcacggcaaattcccattgcacagagtgccgagtttgagaatgtggtgcgtgaagcccaaactttaattgatgaagatgatgaaagtagctacaacttccgtttgcgtgaaaaattgatgggaacagacgggcgtttgagccgtttagccgaagattttgtaaaacattttgaacaacgcaccgctttaattgacggcaaggcaatggtggtggcgatgagccgtcagatttgtgtgaaattgtatgaaaaaatcaccgcacttcgtccagagtggcatagcgatgatgtgaatgaaggggcgattaaaattgtgatgacgggctcggcgagcgatcctgcggacattcaaaaacatatctattcttcgcaagataaaaagctgttagaacgccgttttaaagatcctgacgatccgctgaaaattgtgattgtgcgtgatatgtggctaacgggttttgatgctccgtgttgcaatacgatgtacattgataagccgatgaaagggcataatttaatgcaggcgattgcacgggtaaaccgtgtgttccgcaataaaagccgtgataatggcggtttgattgtggattatgtggggctaaccagcgaacttcgagaggcgacagaacaatatactcgctcgcacggcaaagggcagatgacccacaatatcgccgaaattaaggcaaagatgttggaatatattgatgttgtgcgtgggcagtttgctacacctgtgaacgatcagccgtttaagctgtttgatgccttgaaaattgaagatgaactggcgttgttcaagcaagtaatgttgggggcgaaccatattctcgccttagatcatcaaacggttgcggataaaaccgagaaaaccccaagacgcaatgcgtttttaaaagcggtacgtttggcgaaaaaaggctttagcttatgcggtgcagacggcgatgttcagcagtaccaaaaagagcttgccttttatgatgcggtgcgtgcgattttggcaaaacgtgagccaaattccaccgcttcaagcgaagaacgtcagttgcagttggtggcattattaaataaagcggtggacgcaagcggtgcgattaacctgtttgatttgctcaaccgtgaacagccgaatattaatattttgtcggaagagtttttagagaaaatcaaaaacagtcaaaccaaagagctttggctgttggcggtggagcgttatttgcgtagccaaatcaatgaaaaaggaacaggcaatttggcggtgcaaaaagattttgccgagcgtttgaaacaggcgttaaatcaataccacaaccaaaatctcaccattatgcaagtgttggaagagttgctgaatatgagcaaggaatttaccgaacgcttgcaacgtggggaaaaattgggtttatcgccggcagaaattgccttttacgatgcccttgcccgcaatgaaagtgcggtgcgagaattgggcgatgatgccttgaaaaacttggcaaaagcgattaccgataaactgcgtaaatccgccactattgactggcaatacaaagaagcggtgcgtgccaaaatgcgaaatttggtgcgtgtaacgttgagattattcaaatatccaccagataaatgcgatgaggcaatccaatttgtgttggaacaagcggaagtgattgcggatgaattgacgacggtataaactgcaacgaaacatcaagaaaaaaggaacaacaatgcaatttatcaacatcgccaacgagggcgtgaaaacccttgccccttatcaagcaggtaagccgattgaagaacttgagcgtgagcttgggatttcaaatattgtgaaacttgcctcgaatgaaaacccctttggttttcctgaaagtgcgaaacaagcgattttaaagcagttgaatgatttaactcgctatcctgatgccaatggttttgagctgaaagcgaccattgagaaaaagtttggggttcagcctaatcaaattaccttaggaaatggctcaaatgatctgcttgagctgtttgcccatacgtttgccagtgataaagatgagattatttattcgcaatatgcctttattgtctatccgcttgtgactaaagcgattaatgcggtagcgcgtgaaattcctgcaaaagattggggacacgatttgagtgcctttgagcaggcgattaatgacaaaaccaagttgatttatatcgcgaatccaaataatccgacagggaattttttatcgcaacaggaaattgaacactttttagatagagtgcctgtaaatgtgattgtggtgttggacgaggcttatacggaatttaccgatcctgctgagcgattaaattcttttgcgttagtgcagaaatatccgaatttgatcgtctctcgttcgctgtctaaagcctatggtttagctggtttgcgtattggttatgcggtttcgcaccctgaaattgcggatttattaaatcgtgtgcgtcagccatttaactgtaatagtcttgcgttagcggcggcaattgcagtgatgcaagatgatgattttattgcgaaagtggcagaaaataatcgtaatgaaatgcaacgctatgaggcgttttttaaggcaaatcagttggaatatattccatctaaaggcaattttattacggtagatttgaaacagcctgcacagccgatttatcaggcgttgttgcacgaaggggtgattgttcgtccgattgcaggctatggtatgccaaaccatttgcgtgtgagtatcgggttgccagaggaaaataatagattttttatggcgttgaggaaggtgctgatttagaaggcatagtagacaaatttgtggcgtaccacttaaaaaaataggcttccgatggaagcctattttatttgtaagaaatgggattttcttagaatttataagaaataccggcaaagtaaacgataggatcaagtttgatcttcacttcgtgtgataaacctaaagcatcaaaatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaaaatttgatccaaaacaaatatctgtatctatttacagttaaactggttttatatataatgtttttatatacagtagtcaggtgaggaaaatgttatgcaagcaaccattgatattcgtttagccaacttacaaaaaatggatcaaggtaaattcaaccgacttttagacattgtggcagagcaagtcgaaaaagcatttccaaatgcgattgttcgagttcgaccttcggtatccaatagcgatcttgctgtttttgggctaggcaaagagggaaaacaaaaagtagccacctttttggagcaactttttgaagaaggatcagcctttgacgaattacaagacgagtattattgatcgttttgtttttgccaaaactgaccgcttggtaagacacgaacgctgataggttgtgagtgataataaaaatcgagctgataggcgtgtaaataaactctatcggctttttcaccaccataaagctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagctcaccaaaataacttgcactcgttgggtttagggcaaggattagcaagcctgaagtgactttatcaagacgatgaaccaaccacacttgctctacgccaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagcgattgaaagtcaaggggaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggggaaaagcgagagttaatcgaatttaataagatagaacatttataaatctcttcctaaataacttactaaaattggtgtaatagacaaattggtatagtagacaaatttgttgctaaaaatgggcttaaagccttatcattcaaggtttaaacaataaggcgagatattctctcgccttgccttatctttttccaaaaattagaaattcgcattacgcggtgcgcgtgggaatggaatcacttcacgaatattctgtaaaccggtgacatatacgattaaacgctcaaagcctaaaccaaagcctgagtgtggcaccgtaccgtaacgacgtaaatcacgataccaccaataatcttctgggtttaagcccatttctaccatacgtttatctaacacctctaaacgctcttcacgttgtgaaccaccgatgatttcaccgattcctggcgccaacacgtccattgctgccacagttttaccatcatcatttaaacgcatatagaacgctttaatatctttcggatagtttttcacgactactggagatttaaagtattcttctgcaaggaaacgttcgtgttcagaagagagatcgataccccaagaaaccgggaattcaaaatctttacctgatttaagtaaaacttcaatcgcatcggtatagtcaatttgagcgaagtctgaattaataaagttctctaaacggctgattaccgtgttatcaacgtgtttctcaaagaattttaagtcatctttacgttcttcaagtactgcacggaacacatatttcaacatatcttcagccagttttgcattatccgctaaggttgcaaacgcaaattcaggctcaaccatccagaactctgctaagtgacgggtagtgtttgagttttctgcacggaatgttggaccgaacgtataaactttgcttaatgcacaagcataggtttcgccatttaattgaccagatacggttaagaaagactctttaccaaagaaatcttggctgaaatcaactttgccatcttcaccacgcggtaaattttctaaatctaaggtcgaaacacggaacatttctcctgcaccttctgtatctgaagcggtgattaacggtgttgcaacccaatagaaaccttgctcgtggaagaagcggtgaatggcttgtgctaaacagtgacgcacacgtgctaccgccccgattaagttagtacgaggacgtaagtgagcaacttcacgtaagtattcaatagagtggcgttttgctgccatcggataagtatcaggatcttcaacccaacccacgacttcaacagattttgcttgtaattcaaccgcttgtccttcagctggtgattctacaatcacaccagtcacaatcacagaacagcctgcagttaaacgtaatacttcatcttgataattacttaaatcgttattgataatggcttgaattggatcgaaacaagaaccgtcatacacggctaaaaatgataaaccagcttttgagtcgcgacgagtgcgtacccaaccacgtacagcaacttcttcccctacggcaactttgccagaaagaatctctgaaattgttggaaatttagacatatttataccttttaaaattttgctcaagattttgtggaaaaatcgttagatttatcgcagacggtcgattatagagaaattttccttgtaagactagtaaaacaagcggttaaatcccctttaaagaatacgatattatgtggcagctaaaaactagtgttgtgtagggtggggataaccccagtccctacgaaaagttataatttatgtaagtgctacataatgttaggttttagaaactaagatctaagcctaagataaaatttctgcctatttgtggtacataggggtgataagagttgtgaatgtaaacggcttgatttaacaagttatttcccgtcaaactaacggtatattccacaccttttatttgtctgcggtaatttaaactcgcattgagtaattgatagccttttgttgaactttctaatttggagactttattttgtgtaaagactttcatccattcaactgaacctgagaggtagtctgtcaattgtgcgttaaatcttgcccctaaacgtataggcggtagacgtggcgaaacacgatctgcctgtttaatcatctctttgcctaagtaaggacgatagtattggtcttctggttcatcatattcaggatcgtaatcaggattaagaattggctctccatagacatcatttaatccttttatgtcgggtagctgttttaattttccttttaccatatcgccaaatacactgaattgataatcaggcgtaaaacggtagttaataatgccttcaagtccataaaatgtggctttagcttgattataacggcgcataaagaggttattagagcgatataatgtttcattgtagatataattatcaaaattattgtaataggttgataatttgtaatctaatttttctgtatggtagcccaaacctaattcaaaattattggaaatctctttttttagatctttgtttccatattcaaacgagtttgttgccaaatgttgtccgtgataataaagctccatcggagttggtaaacgttcattatgggaagctgtaaacgagagctgatagtctgggtggaaaaaccaattaaatgccccagtataggagatggctttttcatcataatcagataaatcaggatcaacctgtttaccataagtcctctcattgaatttttgttgtttttgaatcttagctaaatcatagtcaatatgaatattctgcttttcagttcgcaatcctaattcaatcgcaaagttatcccaagcgtattgttccaaagcaaataagctaatttgcttgttgcgattatccactaaaggccattgaacttcacggttgtttggtgtattagcgctgctttgcagggtttgatactgtacgccaaacattccagttaagccaccaattggcgtatgaaaaaactccaagcgggcatttttgccttgatttttgaaaatattgacgggtttaccaaaatctttgctcttatctactcggtttgggttgattgtatcgcctgattttcctgcgtctttttcatcgtgatagtaatccgtttgagcataacttagctgaattttatccaacatcggcaaaggttgtttaatctctccctttatatcaattcgtttagagtgtaaatctacccaaggtccaatatgggtatgatcgtggtcgtgtccataagggtgatcgtggctatggcttggatcgagatcgtagtctgtaccacaatgaaagtgaggattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtgaccatttcatcactcattaaatggggataaagattggtataagaatgctttccttgcaatctcatatcgtaaatatgggcaatacaagtatcaaatttatgattatgcccaggtaatccatatctgtctttacgctgattataagacgctccgagataacctttttcaccaataaaagataaaccaatagttcctacttttgattgatgataagtatctggcacataatttaatgtttcacctagtttaatttgtggcactttataattttgcgattgacgatctaacccttcaagtcgtaaagctaaatgtttcccaattccaatggttgtacctagtgcatacactttctctttgcttgccgtatcaaatcgactggaaagtgtcacttcataaccttttttaggcattttatttggaatacgttgatcaacgatattcacaattccagcgggagagctacttgcataaagcaatgttgaagcaccgcgtaaaatttctacttgattagcaagtagagtatctgcagtgatagcgtgatcgggagaaatatttgacatatcaacaacatcagcattattttgcaaaatcttaactcgaacaccttcttgccctcgaataattggggcgcttgctccacctccaaatggggtgctatgtacgcctaattcactagatagagcattccctaatgttgcagaacgatttttgaatttctctccatcaataatagcatcacttacttttagaaaacttatcgaatttccctcaggaacttttcccattacagaaatttcatcaagttcaagctgctctgcattaatacctaagcagcatagtaataagctaaatgcnnnnnnnnnnnnnnnnnnnnnnnnnnnnnnnnnnnnnnnnnnnntgtttttaatcatttcctatcctttaaaaaccataaaaaaattatggaataatgtaacaaaaatataaaaatagatcaataaccttaaattaataatggatatataacttaaaaaatgaaaaaataatcttgcaacactacgattttgaatgaaaaagtgatacactttgctttgaattattctatttggggtgctttatgtcggaaatgccttcacgcgaatttgctgcgattgatttaggctcaaacagttttcatatgattgttgcaaggattgttaatggctcaatccaaatcctttctcgtattaaacgtcgtgtacgtttagcagaaggattggacgagcatcgccacttaaatcaagaagctatagacagaggcgttgcttgtttagcactctttgctgaacgtttaaaagggttctcgcctgaaaatgtgaaagtcgtaggaacttacacattacgcagggcattaaacaatcaagattttttaacacaagcacaacaagtattcccatttccgattaaaattatctcagggcaagaagaagcacgcttaatctattcaggggtaagtcatacacaaccagaaaaagagcgtaaatttgtggttgatattggtggtggttcgacagaaatgacgataggggatggcttcactccattacgagcagaaagtcgtcatatgggctgtgtgagttttgcaaaacgttttttccctgctggtgaactaactcaagcacgttttgaacaggcatatcaaacagcgatggaaaaaatcgatgatttggcgtgggaatatcgtgagttaggttggcaacacgttctaggctcttcaggaacaattaaaaccgtgagcaaggtgttgattgcaaatggctatcgagatggattaattacagaagcacgtttacaaaccttaattgatcgttgtttagcatttcattcactcaaagaaattcagctcaaaggattattggaagagcgtgccgatgtcttagtgccagggcttgccattttactggcgttatttcacaccttccatattcaatcaatgcgatattccgatggggcattgcgtgaaggaatcttatatggtgttgagagtgaatttcaagttggtgatattcgacaacggacagcaaaagccctcgcagaacaatttaatatcgatcaacatcaagcagaacgcataaaagacaccgcattacgtttgtttgatcaagtgaccgcttggaaaaataaacgtcaaatacaagaattaagagagattttgcaatgggcaagtttattgcacgaagttggtatttcaattaaccacaacggtgttcaccgccattctgcgtatattattgcaaaccgagatctaccaggttttgattctgaacaacaaactttgttagccacattaatgcgttatcacctcaaaggatttaaacgacacgatctcaaaattgcaagtcgctttcagcaccctgatattttaaccctattacgcatattccgcttggcagtgttactaaatcgttcacgtcaagcaacgaatattccaatggaacttaatttatctatccaaaattcatcgtggcatttatcctttgataaagtattcttggcgcagaatcctttgatattggcggacttgcttgatgaggctaggtatttacaagcagttaatttgacgattgattttagctaaaagcaccttattaaatttattattatgctattaaagtaaaaattgagtaaaaataaaattttcttatttatttcataaaaaaaactaaataccattgccatttgctctctttttcggtatatctacacccagttaatttttatcgaaaagaggacattttatgagccaaatttatgaatccatgcgtagtaatattcatatgttgggagattttttgggcgaaacgattcgcgatgcccaagggaatgaaattttagatttaattgaaaatattcgtatattgtctcgtgcatcacgttcaggtgatgaaaaatcacgtgagcaacttcttgatattcttgccaatatttcaaacgaagatgttatccctgttgctcgtgcctttagccaatttttaaacttaacgaacattgcagagcaatatcacacgatttctcgtcacaataaagatgcagcgttaggtgaacgctctatgggtgctttatttactcgcttaaaagcgcaaaatgtgcctgctgaaaaagtaattgcaaccgttgaaaaactgttgattgatttagtgctaaccgctcacccaacagaagttactcgccgttctttagtgcataaacacgttgaaattaatcgctgtttaagccgcttggaacacgatgatttaaccgatgcagaaaccacaaaacttaaacgtcgtttgatgcaattaattgcgttagcttggcataccaatgaaatccgtactcaacgcccgacccctgttgatgaagcaaaatggggtatggcggtaattgaaaatagcctttggaaagcggtacctgaattttgtcgtcaattaaatttccatttagagaaaaactttggtgttcagtaccctgttgggcttgcacctgtgcgtttttcttcttggatgggtggtgaccgtgatggtaacccgtttgttaccgcagaaacgacacgcaaagtgttgcgtatgaaccgttataaagcagccgagcttttccttgaagatattaaatcattagccgacgagctttctgttattcacgcaacagatgccttccgtgcaaaatatggcgatcatttagagccatatcgtgtggtggtgaaagatctgcgtgccaaacttatcaaaaccttagcttattatgatgaactcttgcaagataaaccgcttaccattagccgtgatgaaatcttaaccgatgacgagcaactttgggaaccgctctacgactgttatcaatcactacaccaatgcggaatgcgtattatcgctaacggtggcttattagattgcttacgccgtattcgttgttttggtttaggtttatctcgtttagatattcgtcaagaaagtactcgtcacgaaatggcgattgcggaaattacacgttatatcggtttaggggattattcacaatggacggaagatgataaacaagctttccttgtgcgtgaattaagctctcgccgaccgcttgtcccaaccaactggacaccaagccctgaaacgaaagagattttagatacctgtaaagtggttgcagaacagcctgaaggcgtgatctctgcctatgtgatttctatggcgcgtgaagcctctgatgtactagcggttcatttactcttaaaagaagcaggttgcaaaacaaccattcctgtttcaccgctatttgaaacattagacgacctcgatcattgcgagaaagtaatgaccgatctattcaatatcggctggtatcgtggtgtgatcaacaacaaacagatggtaatgatcggctattctgactctgcaaaagatgctggtatgttagctgcatcttgggcgcaatatcgtgcacaagaagcgttggtgaatttatctgagaaatacaatgtagaattaactttattccacggtcgtggcggtactattggccgtggtggtgcgccagctcacgcggcgttactttcacaaccgcctcgctcactcaaaaatggcttgcgtgtcacagaacaaggggaaatgatccgctttaaactgggtttacctgccgttgctgtatcaagcctagacttatacgctagtgcgattttagaggccaacctttgcccgccgccagaacctaaacaagaatggcgagatgtaatggataaaggctcggaaatttcttgtgacatttatcgtggcattgtgcgtggcgaacctgattttgtgccgtatttccgtgcagcaacgcctgaacaagagctttcaaaattaccactaggctcacgccctgcaaaacgtaatccaaatggtggcgtagaaagtttgcgtgcaattccgtggatctttgcgtggatgcaaaaccgcttgatgttgcctgcgtggttgggggctggtcaagccttacaacagttgatcgaacaaggtaatgaagcgctattaaaagaaatgtgtaccgaatggccgttcttctcaacccgtatcggaatgttagagatggtattcagtaaagcggatttatggcttgcggaacattacgatcaacgtcttgtgccacaacatttacatcgtctaggcaataccttacgcaatcagcttgcagcggacatcaacaccgttctctcgcttgctcacgaagggcaattaatggcggatttaccttgggttgcagaatctattgctctgcgtaacgtttacaccgatccacttaacttacttcaagttgagctgcttcaccgcttacgtgctgaaggcgaaaatccaaatccagccttagagcaagcgttgatgattactatcacaggtattgcggcaggtatgcgtaatacggggtaggggagtatattctggattacaacctcttaatgaattctaagaggttgtttttttagatattataaaaactatttaattattaggatttcattatggaaaaattaacactaaatcctatcgctcgtgttgagggcgaaattaatttaccgggttcaaaaagcctttcaaaccgtgcgttgttgttagcagccttggcacaggggacaacgcaagtaacgaatttattggatagcgatgatattcgccatatgctcaatgccttgaaagctttgggggtgaattatcagctttctgatgataaaaccgtttgtaccgttgagggcgtgggcggtgcgtttcagtggcaaaatggtttgtcgctgtttttaggtaatgccggcaccgcaatgcgtcctttaacagcggcactttgtttgaaaggtgagcaagaggctgaggtgattttaacgggcgaaccgcgtatgaaagagcgtccgattaaacatttggttgatgcgttattgcaagcgggggcttccgtgcaatatcttgaaaatgaaggctatccgccgattgctattcgtaatttgggtattcaaggcggcaaaattcagattgatgggtcgatttcttcgcaatttttgaccgcacttttgatgtctgctccccttgcctccggcgatatggaaattgagattgtcggtgagttggtctccaagccttatattgatattacccttgcgatgatgaaggattttggcgtgacagtgtcgcataataattaccaaactttctttgttaaaggtaatcagcattatgtttctccgcaaaaatatttggttgagggcgatgcgtcctctgcctcttatttcttagccgcaggggcaattaaggggaaagtgaaagtgacggggattggtaaaaattccattcaaggcgaccgcttgtttgcggatgtgcttgagaaaatgggcgcgaaaatcacttggggcgaagattttatccaagcagagcagggggagcttaaaggcattgatatggatatgaaccatattcctgatgcggcaatgacgattgcaactaccgctctttttgctgagggtgaaaccgttattcgtaatatttataactggcgtgtgaaggaaacagatcgcttgacagcaatggcaacagagttgcgtaaagttggggcggaagtggaagaaggggaagattttattcgtattcaaccgcttgcgttagataagttccaacacgctgagatcgaaacctataacgatcaccgtatggcgatgtgtttctctttggtggcattgtcaaatacgccactgacgattttagatccgaaatgtaccgcaaaaactttcccgacgtattttgatgaatttgggaagatgtcttgtaattttagtagggaagaaaaataatcttattgggattgaggctattttaaacaagcattaagaggattcaaaagacgggtactgtctacctgttaaggttttaattactatttttgtctattatgccaaagtctttattaagggtaacaaattaggggctaaagtagcccctaagaaattattcagtaattggtacaatgcgtacagctgaagctcccttatctccatgagtgaactcaaaatgaactttttgtcccatttttaaagagcggtagccttctccttcaataactgaaaagtgagcaaaaatatcaccttcatatgagtccgaagtgataaatccgaatcctttggcgttgttaaaccattttacaataccaacttccataataatgtttctcccttggttagattatgatgtaaattttagtcaaatatgtaaaatgcgcaataggaaaagttaaattttacgacatagatcacaaatttttattcaaaatcgaattgtgaaaatcttcctatgcttaatattttagtgcatatttagaatatgatatacttattgtctctataatgagctaaaaggaataataatggatacattaagggtgggcgatactgtaccatcattctctctattagatcaaaattttaattgggtaactctagagcaatttccaaacaaaaaatttctaatttatttttatcctaaagcattaacaccaggttgtacatcacaagcatgtggtttacgtgatagcaaggaagaacttgattctttaaatgtgatggttctgggcattagtcctgattcgccagaaaagctagcaaaatttcttgagaagaatagtttgaactttattctattgtcggatgtggatcataaggtagcagaagcatttggcgtgtggggaaagaaaaaatttttaggaaaaagttatgatggggttcaccgaattagttttttagtggatgagtatggcaaaattatgtctgtatttaataaatttaaaacaaaagaacatcaccagttggtaattaactttttaaaaggcaatagtgatggcgaataaagctatttttctagatcgagatggtacaattaatattgatcatggctatgtacataatattgatgatttcaggtttattaaaggcgttggccatgcattaaagcaattacaagataaaggatatatgctagtgatagtgactaatcaatctggaattgctagaggctattttagtgaaacacaatttcatcaattgacagaatggatggattggtcattagatgaagactatggtgtggtattggatggtatttattattgtcctcatcatcctgaaggaattggtaattataaaaaggcttgtgattgtcgtaagccaaaagctggtttattgctacaagctatttctgatctggatattgacccttcaaaatctatcatggtaggagataaattagaggacatattagctgcgaagaacgctggggtgaaagtgaaaatattggttcggacaggtaaaccaattacacctgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgaattaaacgctgattatgttattgatagtgttgctgatttacctaaattcatagatggccatgtagatgaaatgatgtagtgaacacatttaaatgttgattaatcttaaaaggagaatgggtagttttatttaatcaaagaatattgaggtataatggcatttgatacatcatattgtatttttaaatagtatatagataaaaggtttgtttatgaaaaaacatcacattgaaactatgatatcttctcaagaagttcaaaaccgcattactgagttagcagaacagattaatcaacattaccaacataaaaatagccagagtctggttgttgttgggctgttgagaggatcttttatgtttatggctgatttggtgcgtaagttaaatttacctgtcgaggtcgattttttaacggcatcaagttatggattaagtacagaatcgagcagagatgtgaaaatcttgaaggatttggatagtgaaattcaaggcaaagatgtattaattgtagaagatattattgatactggttttacccttaacaaagtgcatgatattttaaatttgcgcgaaccttcctcacttgcgatttgtactttattagataagccttctcgtcgagaagtggatgtaccagtagaatgggttggctttgctatccctgatgagtttgtggtgggatatggtattgattatgcacagcattatcgtaatttagattacattgcgaaagtgattattgatgaataagaagtgaaactttcaattaaattaaccgcttgttgatataaacttcaagcggtttttaatttctaattgggctttagtatctaggagagtttatggggaaaaaaatattatttgtttatttggcgatgtgtttatctgcttgggctacgcagtctcagtcatctccagaaattgagaaactaaaattacaatggcagaacgagcaacaaaatatctaccgtcaattggaaaagcaaagagtaaattttttgctgcttgagactttattacgagagatggaacgagagggaaaattttctaatgcgatatttgagcgagtggtgcatttagaggcaatgttgcttgattaccctctgattgaagagataaaatgggctatattaaatactaaactaaaattgaacgctatttcgcaagaagaaattctgcactttatcaagcaatatccgcatatcgcaaaacgcaataagctggaacagttcccgatagaaatgtggtacaaacagcaaaaatggtcagagcttctagcctatagcgacaaagtcggtgagctaagcgttgctaatcaatgtcgagtgtgggcggctcaatatcaaagccaagcagataaattacagttaaatccagaagcggcacaagcaaataatctggctcaacctttatcgcctgagttagctcagcttttagcaaagtttgatgatttttggatcaataacggctcattgccctctgactgtgcgaacttggaagccttctggcgagatcaggggttaaaaaccgaagataaagtgaagcaaaaagcggtcaaattatggataacaaatgcaaaagcggagttaagccagttagcgttaaataaccaagatgtcgagttaggaaaatggcttgccgatttacaaaaactcttgtctgagccgaattatttgcaacattttattgcgaaacaaccgcttaacgatctcaataaacagcttgtattgcacgctttccccaaatttctcaaaacattgcctgaacaaatgcaaaatgtggattttgccccatatcaaacttgggcagagcagtggcaacttagcgaaaatcaagtacgtgaatggaaaatccagtttctacaacgcttttttgataacacaacaccccagttccagcagtggcgagatgcacagttagccgaattaaaagaggatagtttaaccgaacgccgcttacgaatggcgatctggcagaaaagcgatttaaatagatggttagtgctattaagcccagaaaccagagccaaagcggaatggcgttattggttagccaaaagccagccggcacaacaagcggctattttccagcaacttgccacagagcgaggattttatcctatgttggcggctcaagccctaggacagccttatcagctcgtattgccagcgattaacaaattaacagaacaacaaacccttaaatttaagcctcagcttaaccgcattgcagagttaagggcgttaaaacggctgagtgctgccaaaattgtttgggtagatttactgcaagcggcgagttttgacgaaaaaattgcattgagtaactttgctttgcaacaagattggtttgatttagccgttgaaggaaccattcaggcaaaagcgtgggattatttatcgctacgtctgccaaatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattcagattggtttgaactcaatttacagaataaaaaaatcactaaaacctttgcaatggcaatcgctcgccaagagagtgcgtggaatgctcaagcacgttcgcacgcaaatgcaatagggttaatgcagttattgccaaccacagcaagccaaacagccaaagcaaatcaactgagctatacaggggaaaaagatttactcgacccttttaaaaacattatgttggggacagcccatttagcagagttaaatgaaacctacccaaataaccgaattttaatagcggcggcatataacgcagggcctcaccgagtgaaccgttggttagaacgtgcaaatggcactttggcgatggacgaatttattgcctccattccttttgtagaaacaaggggatatgtgcaaaatgtgttagcttacgactattattatcagtttttgtataataaaacattagttttatttacgagagatgaaagagaaagaagatattaattctttaatgaataaaaagaataatgaaaagttttattggaatactttaactaaagtctattttacatatgaggaacaatggcgtgacaatgttacgaaaatccttttttttaccgctatttttaacgggctgcgtgatggtaccaccgcaattttcgatacctgaacaggttaattttcaaggtaaaacctaccaaaaagtgatccaaaatcagcttgatgaaatgcaacaatcgctttttttactcaaagaaagctcaaaagatccgaataactggcaacaaggcattttgttgtttactgataaaaacagccaacaaaaaagccttgctgatagggtggagttacgtcagcaaactttcgctaaacagcctgataccaaagcgaaagtggcgattattggtgacgagctacaaagccaagtgctttatccacccacagagcgttttaacgattatcagctggaagtcacccgtgggcaaaattctcagtgtggttacagccaaatgcagttctcagacaagcggtctgtttctgcaaaaaatttgcaaaatccaaccgcttatatgaaagatcttcagcaaatggcgtggcagttttcgcaattagcgtggcaaattgagtgtaactaatggaaaaacagtataatcaatatgtaaaaagagcagcgaactttgctgtgattgtcgctgccaccttaattattgcaaaggcgtttgcgtggtggcagacaggatcgatggcgattttagcggcgatgacggactcgttagtggatttgttcgcctctttaaccaatatgctcgtgttacgttttgctttacagccagccgatgatgatcatactttcggacacggcaaagcggaatcccttgccgcccttgctcaaagtgcctttatcactggttctgcaacattcttattgctacaaggtattcaacgtttaaccgaaccacaattagtacaaagcagtgaattaggcgttgcgattagcttgttctccattgttctcactgcagcattagtttggtatcagaaaaaagtggtaaagctcacccaaagcccagcgattgaggccgattcgttacattatcagacggatctctatatgaatgcggcaattcttgtggcaatgattttaaatatctacggcgtaatttatgccgatgccgtatttgctattggcattgccctttatattctgtttaatgctgccaaaatgtgttgggaagcggtgcaatccttgttggataaagccttacctcaagaagaagtcgatcaaatttgggcgattgctttgcaacacccacgcattattggcatacacgatgtcaaaactcgtcgtgcaggggcaattcgctttattcagctacatttagaattggacgatcatctgcctttggttgttgcacacgatattaccgacagcctagaacagaaaatactggcagtctttccccattcggaagtgattatccaccaagagccaacgacgattgtaaaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaccaaatgtattgagccattgcataagtgattgaaatccttctggattatttttaaacactttatgcttatgtttgccattttgtaatttaatggcaacatcaaatttagctttggcaatatcaatgccaacgtaatataatgggttatccatttgacctccaaaccttgtgaatgcgggctacggaaaacgtgcctgagataccattcggggtgatagtggatgagaaagtaggcttatatctacactacgtgcttaatggcacaaggggcraagcaactctactttctctataaccccattatgaaggtactcgtaatggggttttcttttgcccatattctaatacaaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtaccaagccttagcccaagcggaagaagccggcatggtttttgagtattaagcggtgtaatttgaatgttttttcggtattatgtatcagctacgtaaatatctcagcccttttgaaccgagggctgagagtaatttgttgtctgaatataaatacatacaaagttaaccccgatgaaaaccgctcaactttaccgttattccttacctgttgaaacaggcattatcttacgtaaccgccgtttaaaacaacgagatggtttgattattcatttgcaacatgctgacaaagaaggctggggggaaatcgccccattgcctgaatttagccaagaaaccttagcagaggcggaaattgcagttcgccaatggattgaaaagtggctaaatcatcaagacgattctttaacatcctatccaccgtccgttgcatttggggtcagctgtgccttagcagaactcaatgaaacattaagcgaagaagccaactttcaaactgtgccactctgttatggcgacccagatgaactttatgcagaattgaaccaaatgcaaggggaaaaaatcgccaaaattaaagtagggttatatgaagctaatcgagatgggcttattgcggatatgtttttagaagcaattcccgatttaaaattgcggcttgatgctaatcgctcatggacgctagaaaaggcgttgctttttgcaagtaaaattgcccctgaacgcaaaaagcgcattcagtttttagaggaaccctgcaaaactccagaactttcacgtcagtttgctgaacagacagggataaatatcgcttgggatgaaacagtacgagagcctgattttttggtaaaaaaagagccaaatctaaccgctattgtgattaagccaacgctcgttggttcccttgaaaaatgtatttcactcattgaacaggctcatcagcaaggtttaattgctgtgataagttcaagtattgaatctagtcttgggcttactcaactggctcgctttgcgactcaatatactccaaacactttggctggtttagatactttagatttaatgaaagtacagttattgcgggagtggaataattcaactttaccgatagtgcatttaaatagcccgtatattttgggattagacgacaatgttaagtaggctatgtgataatgattaaatagcagcctgttcaagagacgatgcggtgtaaaatatcccatctaaatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgtgggaagtggtttaggtttgaaagatgatgctgaatcaaataaaacggcacttacccctacagatgcacaaaaagctattgctggtgataacaaagacggtaaaggcggyttattggctcaaacgggtrawgygttaaataatgtagcgacagtraaagayttacaagccattgcacaagcgggcttagacytsacgggtaacaacgccgataccactgtacatcgtccattgggtacgaagttaaccgttgagggtgaaggcaaatggaatggtaaggactcagcggctaataacctttatgtggaagcgcaagwggcagataacaaacttgttgtgaaaatgaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggatttaacgaacttaaattctgtgactttagrcactgcgacaatgactggtgataagaatacaatcaaccttactggtgcaggagagaaagtcgaggaagagtttgttaaatgggacccagtgactaaacaacctattcttgatgagaatggcaatctccagaaatataaagagaaagttgatcctcgtgtgaaactgagtggtattgctgatggtgatatttcaccraatagtactgatgcagtgaatggtcgycaagtttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagttctgttgctttaggtaacggggctacagctggagagcaaggcgtggctattggtcacggtgctgtggcrtcaggtaaacaatctatttcgattggtaccggcaatgtggtgagtggtaataactcaggtgctattggtgaccctaatacaattaaagcagatcgctcttatgcattaggtaataataaccaagtgaatgcaggtcaatctgatgtgtttgttgtcggtaacaacgtgaaaaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgggtttagtggtaggtttgaataaatttttgataggcattcaaaaacatttcaaaatcttctaatccacaaaaggcgatactttcttcatcatagaaactaaaaccattttctatgtcttccatttgttcaaaagtcatatccaaattattcgctttcaccatcacttcttcaatgttgatataaaggctatattctttaccttcaaaaatccattcgtagttttgatctttggtttggcgacaatgctcaatttcggcaaaaatggcggttaactcttttggatttggcacaatctcggtatttaaccaacgagcaaatgcctcgtgatccattgaacatttggcaataacgccgtgcatggtatgtgtaaattggtattccatcattttctcctttcaaacaagcggtcggattcgtttggttttttgcaaaatattataacgaagtgaccgcttgcaactacaacttaacctttcttcaaaatctcttttaaaaatcttgccgtatgggatttcttatcttttgccacctcttcaggtgtaccttcagcgataatctgtccgccgccgctaccgccttctgggcctaaatcgacaatccagtctgcggttttgatcacatctaagttatgctcgatcaccacaatggtatttccttgatcacgcaagcggtgcaatacggtcaataattgtttaatgtcggcgaagtgtaatcctgtcgttggttcatcaagaatatagagggttttgcccgtgtcacgtttggataattccgctgccagtttcacccgctgagcttcgccacctgacagggtggtagaagattgccctaaacggatataggataagcctacgtctattaaagtttgtagcttacgtgcaatcatcggcacggcatcaaaaaactcacgagcttcttccacagtcatatctaacacttgatgaatggttttgcctttatagcgaatttcaagggtttcacggttatagcgtttgcctttacagtggtcgcacggcacatatacatcaggtaagaagtgcatttcaactttgatcaccccgtcaccttggcaggcttcacaacgtccgccacgaacgttaaagctgaaacgtccgaccgtatagccccttgctcttgcttcttgtgtaccagcaaagagttcacgaatcggggtaaataaacctgtataagtcgcagggtttgaacgtggcgtacgtccaatcggactttgattgatgtcgattactttgtcaaaatgtgccaagccatcaatgctcttataaggggcgacatcgctgttttctgcacgatttaacgcattttgagcaatcgggaataaggtgtcgttaattaaggtagatttgcccgaccccgatacccctgtaatacaagtaaacaagccaacaggaatagctaaatcgacttcttttaagttattaccgcttgctccttttaacaccagctgtttgctttcatctcgtggggtacgctgtttcgggatctcgattttttccttacccgataagaatttgcccgtaattgatgcttcattttgcataatttcttgagccgtaccctgagcaataatctgcccaccgtgtacccctgcccctggtccaatatcgacaatatgatccgccgccataatcgcatcttcatcgtgttcaaccacaatcacggtattacccaaattccgaagatgaataagagtgttcaataaacgttcgttatctcgctgatgcaagccaatagacggttcatcaagcacatacatcacccccactaacccagcaccgatttggctggcaaggcgaatacgttgggcttcaccgcctgataaggtttctgccgaacgagagagcgaaaggtagttcaacccaacattgacaaggaaagacaaacgctcacggatctctttgagaattttttccgcaatttgtgctttctgcccagatagatgtaagccttcaaaaaattctaaggcttcgccgatacttttttccgacaccatcggcaagttggttttctctaaaaagacataacgggcttcacgacgtaaacgagagccttcacaatcggtacaagtacgattattaatatatttagccagctcttcacgcactgcatttgactcggtttccttataccgacgagccatattattcagcaccccttcaaaagtgtgaactcgcttaacgctatcaccccgatcattcacatagacaaattcaatttcatcttttgaaccatttaaaatgatattttgaattttcttcggtaactgattaaacggcatttcaatatcaaaatcataatgtttcgccaccgatttcaacaaaccgaaatagtagaaactacggcgatcccaacccttaatcgcaccgcttgctaaagacacatcagggttttgcaccactttacgttcatcaaaatattgctgaactcccaaaccatcacaagttgggcaagccccagcaggattattaaacgagaaaagacgtggctctaattccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgacgaaaacactaactcttccgcatttggatcgtccatatcggcaataatcgctgttgaacctgagagttccaatgccgtttcaaaggactgcgctaaacgggtcgcaatatcgtttcgcactttaaaacgatcaatcaccacttcaatcgtatgttttttctgcaattcaagttttggcggatcggacagatcacaaatttccccatcaattctggcacggatataaccattagcggtcagattttctaataattttgcgtgttcacctttacgatctttcaccacaggagaaagcaacatcaaacgcttaccttcaggctcttccagaactctatccaccatttgcgaaattgtctgagccgctaacggcacatcgtgatcaggacagcgaggctcgcccacacgggcaaacaacaaacgcaaataatcgtggatttccgtcaccgtccctaccgtagaacgaggattgtgtgaggtagatttctgctcaattgaaatcgcaggggaaagcccttcaatgtgatcgacatcaggcttttccattaaagacaagaactgacgagcataagcggataaactttccacataacgacgttgcccttcagcataaagagtatcaaaagccaaagacgatttgcctgaccctgacaaccctgtaatcacaataaatttatctctcggaagaaccaaattcacgttttttaaattgtgggttctcgccccacgaatatcaatatgttgcataactgccttctaaataaatgtaaagcaaaaattttcaaattttcgattattatcgcataaattgattaactgtacaaaatatcagttttagtagatgattttttttttattttcaggcaaaataacttttaatgttttacaatattatgtacaaaaatacataactattatttttgaactaatgaggtagggacacactgcgtgtgtccccgataaatacaaacatatagtttcggacacacgcagtgtgtccctacgcaaaactacatttaaccaacacaatttatttaagaggatttgatatggcaggtgtaaataaagtaattattgtcggcaatctcggtaatgaccctgatatgcgtacaatgccaaacggcgatgcggttgcaacattaagcgtagcaaccagtgaaagttggaacgataaaatgacaggcgaacgccgtgaggtcaccgaatggcaccgtatcgttttcttccgccgtcaagcagaagtcgcaggacaatacttacgcaaaggttcaaaagtttatgtagaaggcaagctcaaaacacgcaaatggcaagatcaaaacggccaagatcgttacaccacagaaattcaaggcgatgtactacaaatgttagacagccgtagcagtggcggtgattttggcggaaatcaaggtagcggttggaaccaagcaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacctgcggctcaagcagaaccaccaatggataattttgatgatgatattccattctaaaatcttatattagagatgaaagcccagcagtttgctgggttttttgttatagctaggactgctttaatcaccctgaaagcattaagatgatttaactaggttattttgtaattggaattctgcacgtatttgaaattagtttcaattataattgaaactttatttatttaagagtaaagtattaattataaatgaaagggggtagtgtgaagaaagatttagtttatcgccaaaaataccttgaaacggtgcgtccgtttatgggaaaacgtctaataaaagtgttcactgggcagcgccgtgtggggaaaagttatttgctgtttcagattatgcaagaaattcaaacggcggatgaaaatgcccacattatttatatcaacaaagaagacttggcatttagccacattacaaccgctgaaagcctaaatgattttgtgcaggagcagaaaaagagcggtcaaaaaaattacatttttattgatgaaattcaagaaattacagattttgaacaagcattgcgttcgcttttattagatgatgaattggatttgtattgcacgggcagtaatgctcatttgctttcacgtgatattgcgggcagcctgagtgggcgggccattgaaattagtgtccactccctttcctattttgaatttcttgaatttatgaaactggacgatagcgataaatcaatgtcgctgtttttgaaatacggcggtctgccttatttgaaagacttgcccttgcaagacaatatcgtatttgagtatttacgcaatatttattccaccattgcgattcgggatattgtgaaccgctatgcgttacgaaatgtgcaatttttagagcaacttacgcaatttttagcaagcaatatcggcaatctgttttccgccaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgttttccgccaaaaaaatctctgattttttaaaatcgcagaaaattgccacgtcaagcacacaggtgcaaaattatgcggaataccttgccaatgcctttttgatccacaaagtgccacgctatgatattgaaggtaaacggatttttgagattggcgaaaaatactattttgaagatttaggtttgcgaaacgccctgattggctatcgagtgcaagaccgtggcaaattgctcgaaaactgcatttttaatcatcttcaaatcgcaggttacgatgtcaaaatcggtggtttaaatagccaagaaattgacttcgtagcagagaaaaatggcgaacgcatttatgtgcaagccacactcacgattaacgaagaaaaaacgctcgaacgagaatttggcaacctgctcaaaattcaagacaactaccccaaatatgtggtgacgatggatgaatttgagggtaatacctttgagggagtgcagtgcttgagtttgaggaggtttttgaaggagattttggggcaaatgtgatttgcccctacgatgaaatgtttgtgtaattgctacataaaaatcaatccaaccccttctccttcaaccacttcgccaaatacgtcccagaaagaaactggaaatccgtttaaatatgcttcaccactcagtccaaattgatcgatacgttctgcaatttttccttgataacttcccgcttgcactaagccagataagtcacctttgacatcaactaggaatacgggaacgccatcattgctaaaagtttcagcaagttttcgcaatgtaacagttttccctgttcctgttgccccagcgattaaaccgtggcggtttgccatcttggctgttaaagaaatgggattgcctgacttgctgtgtgcaatggtgtaattaattttttctccttatttatatttcttgccttgtggtgttcttgttttggctttttgtggctttggcaatgctaaaagcacttcactgtcgtattgacttacggggatagcgtgtccgatatattcttcaattgcaggtagattaacggcataacgttcacaagcaaagctgatagatacgccactttccccggcacgtcctgttctgcctatacggtgaacataatcctcacggtcgtctggtaaatcatagttaaagacgtgtgtcacatctggaatatgtaatcctcgagcggcaacatctgttgctactaaaatatctaattccccttgcgtaaaactatctaataatgccaaacgttttttctgtggtatatcgcctgttagcaagccaactcgatgtccgtctgcactaaggtagctccaaatttcttcgcatttatgtttagtattggcaaacacaatgcaacgatcaggccactcttcttccattaatgttagaagtaatgccattttatcttcattagaagggtagaacagttcctctttaatccgatgccctgtgcgttgtagtggctcaatttccacatattctgcattgtgcatatcttcaaatgccagttcacgcacacgatgagagagcgttgcagagaacaacattgttaaacgctcttcgggtttcggacattttcgcattaaatagcgaatatctttgataaaaccgagatcgaacattcgatccgcttcatctaacaccacgacttgaattttatcgagatcaataatgccttgtttgacataatcaatcacccgtcctgttgtgccgattaaaatatcaactccacgctcaatctcttgtagttgtttgtcgtagccgtcaccaccataggcaagagctaaacgcagatccgcatactgcgttaaaattgatgcatcagaggcaatttgtaccgcaagttcacgggttggtgcaagaattaaagcacgaggttgattatgtttggttggaatatcgtgatttaatagatgatgaaaggtcgccacgatgaatgcaagggttttccctgttcctgtttgggcttgccctgcaatatcttgtccgatcagtgtataaggcaacgttttcgcttgaattggtgtgcaaaattcaaagcctttgctatcaagagcagccaagacactgtcgtgaatcggaaaatcaataaaacgttgttcagtaaggtgtttagacattatgttctcctataagcaacaagcggtaaattttgagcagaacgttgcaacatacaacaagtgctatgcaaataacggctgaatattaaaacttgggcgttgttcaagctgccaaagatcgtattgggattgtaaaccaagccataattctgggctagtttttaataattggcttaatctaagagccatttcaggtgaaattgcagctttgccatttaaaatacgagaaagcgtgacacgagtgacacctaaacgtttagccacttctgtgacattatatccttcaatatattctcttaaaataagccctgggtgagctggattgtacattttcattgatagctccttaatgataatcttgatagtccacgacttcagcgtgaccattttgaaatttaaaagttaaacgccaatttccacttaccttgatagaccaatgcccagctagattaccttgtaattgatgtaaattccagctaggtgcattcatatctaaagcactttttgcttggtttagagtggctaattgaaaagcaagtttactagcgtgatttgcctgaatacctgcagttgatcctgtttcaaaaaataatttcaatcctttatgcttaaatgaaataatcatctgccctcctgattgtatcgctaaactatacagaaaaagagatgggatgtaaagcaataggatacatcactcccataaattcccattgttctcttattgaaaggctttataataaaagccttatttatttcaaatcaggaaaatcattatgtcagcaaacaccatcaatcttaaaaatcgccattttttacgtctaatggatttcaccccaaatgaaattcaatacctgctagatttatctgcaaaattaaaagcagacaaaaaagcaggtcgagaagtcccaacaatgcaaggcaaaaatatcgcattgatctttgaaaaaagctcaactcgcacacgttgtgcctttgaagttgccgctttcgatcagggggcgaatgtgagttatattggacctagcggatcgcagattggacataaagagtcaatgaaagataccgctcgtgtactgggtagaatgtatgacggtattcaataccgtggttatggacaagtgttagttcaaacattagcagattattcaggtgtacctgtttggaacggtttaaccgatgaatttcacccaactcaaattcttgccgatttccttacgatgatcgaacattcaaataagccactcaatcaaattaagctcgcttatttaggtgatgcgcgtaacaatatgggaaattcctttgttgagggcgcggcattaatgggggtagatttacgtttagttgctcctaagcagttcttccctgaacaaacattattagatgaagtcgcagaaatggctacgaaaacaggagcgaaaatcacctgtacggaagatgttgcagaaggggttaaaggtgttgacttcgtctatacggacgtttgggtatcaatgggtgaaccagaatccacttgggaagctcgtatcaatttaatgaagccttatcaagtgaatgctgaattgatgaaattaacgggcaatccaaatgtaaaattcttacattgtctacccgctttccacgatgaccaaacccttgtaggtaaagaaattgcagaaaaatatggaatgaacggcttagaagtaacggatgaagtatttgaatccgaagcctctattgtttttgatgaagcagaaaatcgtatgcatacgattaaagcggtgatggtggcgacattggcagggtagagtaggtgcgggatttacttgcatctttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgggggaagaatttatggctgtgtaaacgaataacaccatttaccctctaacaaaagggtgttttaatgctaacgcatgcatggtttcgtgtaaaagggtagaaattccttgattttctggggtgagcttgtcagaaaatttcaaggcattcagtcttagttttagtttgcttcttgatatttttattacaatcatcagaaaaaactgctatctaaagtcaaaaaaactgcgtagaatatggatagatcaattacgcaaacgattacttataggaggaaccaatgttaagacgtgatatgaatatcgcagattatgatccagaattatggcaagctattcaaggcgaaaatcgtcgtcaagaagagcatattgaacttattgcttctgaaaactatgcaagtcctcgtgtgatggaagctcagggttcacaatttaccaacaaatacgcagaaggttatcctggtaaacgttattatggcggctgtgaatatgcagatattgtagagcagttagcgattgaacgtgcaaaagagttattcaatgcagattatgtgaacgtacagccgcactctggttctcaagcaaatgcnnnnnnnnnnnnnnnnnnnnnnnnnccaggtgatactattttagggatgagtttggctcacggtggtcacttaactcatggcgcatctgttagtttctctggaaaaatctatcatgccgaacaatacggtattacatcagaaggcgttattgattatgatgctcttcgtaagcaagctcacgaagttaagcctaaaatgattgttggcggtttctctgcctattcacaagtagttgattgggcaaaaatgcgtgaaattgctgatgaagtaggggcttatttatttgtcgatatggctcatgttgcaggattaattgctgcaggcgtttatccaagcccattacctcatgctcatattgtaacaacaactacacataaaactttaggtggccctcgtggtggtttaattctttcaagtgcaaaagatgaagagttataccaaaaactacaaagtgcagttttccctgctagtcaaggtggcccattagttcatgtaatagctgccaaagcggtttgctttaaagaagcgttagaatctgaatataaagcttatcaacaacaagtggtgaaaaatgcaaaagccatggtggaagtatttaaacaacgtggctataacgttgtttcaaatggtacagaaaaccacttattccttgttgatttagtaagccacggtttaacgggtaaagcggcagatgcagctttaggtaaagcaaatattactgttaataaaaatgcagtaccgaacgatccacaaaaaccattcattacttctggtattcgtgttggtactccatctgtaactcgtcgtggttttaaagaggctgaagtacgggaacttgcaggttggatgtgcgatgtattagataacatcggtaaggataacgaagctgcggtaattgaagtgactaaagtgaaagttttggatatttgtaaacgtctacctgtttatccataaaattaacaaatagatttgttgtgttatcctcttgtcattatttgttttagttacaatattgacaaggggataatttatttgaggataacatattgaatcctttaaattttattatgaaaaaccatatcctaaccatcagtcagctcaattactccgttaaacagatgcttgaagtcgaatttggcagtgtttggcttatcggcgagatttcaaacttttcgcaacctgtttctggacattggtatttaaccctgaaagacgaacaagcacaggtgcgttgtgcgatgtttcgtatgaaaaatatgcgagtgaatttccgtccgcaaaatggtatgcaagtgttggtaagagcgaatgttagcctgtatgaaccacggggtgactatcaagtgatcattgaaacaatgcagccggctggcgatggcttgttacaacagcaatttgaacagcttaaaatgaaattggctgggttagggttatttgctcaagaacataaaaagcctattcctacgttcgtcaaacgtgttggcattgtgacatcatcaagtggtgcagcgttgcaagatattttgcatattttacaacgtcgagacccaactcttgaagttgtgatttatccgaccttagtgcaaggcaaagaagcgacagctgatattgtgcagatgatcgagcttgcgaaccgccgtcaggaatgtgatgtgctgattgttgggcgtggcggtggctcactggaagatttatggtgctttaatgaagaagcggtcgcttgggcgatttatcactctcagatcccgattatcagtgccgttggacacgaaaccgatgtaactattgcagattttgtggcagatttgcgtgcgccaacgccgtcggctgcggcagagttggtcagccgtgatcaacaagagttgttacgacagttacaacatcacgctgataaagtgaatttagcttttgatcgcttatggagtgaaaaattagcccgatttgaccgcttgcaactgcgtttacaggcgcaacacccacagcgtcaattacagcaacgtgtccaacagctttcgcacttagaaaaacagctgaaacagcagatggaacagctattgttgcgtaaacaacagcgttggaaaaatacgctacaacgaatggaacgaaatccgcttccttaccgtatttcagcccaaacacaacatttgcacaagctagagcaacgtttaagctatgccattgagaagaatatcagccaacgtcgccagcaatttcaaaccctttgcacgcagttagacggcttaagcccgcttgctattttagcaagaggctactccgtaacacaaaaccaacaaggcaaagcactgctatccactcaggatatttcaatcggtgaaacgatagtcactcgtttagcacagggaaatgtggtaagtcaggtggtgggtattctctagaatgtattaaggggaataccattccccccaatcctaatctacaatttcaacttcaacattaccacttagccctcgaagttgcgtgccttttcttgctcgttcgccacgataatgttcaatatctgttggttttagcgtaattttacgtttacctgaaacgaaaaccagcgaacttgttaggttgattataagtaatcgagaaagtagctctgctcgttctttcgcagcttgtgcagaaatgttgatgatcttatttcccttgcctttagataactcaggcaattcagaaactgggaagactaacactcgccctgtattgctcattgccactaacagattttcttcaccctcttttaacaactgcggtggtagcacttttgcattttccgttaaggaaataaccgctttccctgccttgttgcgagaaaccagatcttcaaattggcaaataaagccatagcccgaatccgaagccattagtaccttacgactttcctccgccattagtacatattgcaccgttgccccatcaggtaaactgattttgcccgtaataggttcaccttgcgaacgagcagaaggtaggctaagaggatcaagtgcatagctacgccctgtgctgtcaataaagacaactggctgattgctcttaccataagcgtgggcaaggtagctatcgccagctttgtaacttaggttctgcacatcaatatcgtgtcctttagcacaacgtacccagcctttttcggaaagaattaccgtcacaggctctgttggcgttaaatcgctttctgaaatcgctttcgcttcagcacgctccacaagtggtgagcggcgagggctggcaaaggctttggcatcggcttcaatctctttcttaatcaagttatttaaacgacgctctgaacctaagatcccttgcaaatgttcccgttcttcttcaagtttctgctgttctgcttttaactcgtgttcttccagttttgccaaatggcgtaaccgtaagtttagaatagcttcggcttgctcatcgcttaattgaaaacgtgcaattaattcagctttgggattatcttcattgcgaataatctcaatcacttcatcaatattaaggaaggcaatcatcaagccctctaaaatatgtaaacggctgatgattttatccaagcggaaatttaaacgacgtgtgaccgttgttctacggaatgctaaccactcagtaagaatggtcagcaaatttttcaccgcaggtttaccatcaagcccgatcatattcatattgatacggtagcttttttcaagatcagtggtagcaaacagatgatccattaagccatcataatcaatacggttagaacgtggttctagcacaatgcggatagggttttcgtgatcagattcatctcgaatatcatcaaccatcggcaattttttatttcgcatttgtgttgcgatctgttcaatcaccttagatggcgaggcttggtgaggtaatgcactaataacgatattattctcttctcgcttccataccgctcgcattttaatagagcctctgccctgctcataaatctttgcaatttctgagcgcggtgtaataatttcagcttctgttgggtaatcagggccttgaaccacgtccaaaatatcgctaagactagcggttggattatccaataattttactgaagctgccgctaactcgttaatattatgaggcggaatatctgtcgccataccaacagcaatacctgttgtgccatttaataaaatatgaggtaaacgggctggcagatatttaggctcttctaatgaaccatcaaagtttggctgataatcaacggtaccctgccctaattctcctaatagaatttcagccattttggagagttttgattcggtataacgcattgcagcaaaggatttaggatcgtctggtgccccccagtttccttgtccatcaattaatggatagcgataagagaacggctgtgccatcaaaaccattgcttcataacaggcactatcaccgtgcgggtgaaatttacctagcacatcaccgacagtacgtgcagattttttatattttgctgcagcatttaagccaagctcagacatcgcataaataatacgacgttgcacaggttttagaccgtcgccaataaaaggcaaagcacgatccataatgacatacattgagtaattgagataagcgtcttccgtaaaacgcttaatcggcatttgttcaacgccttcgtaattgatttcagtggtcattggaatataaatactattgaaaaataaaagagcttatcttgacaattctctcttatttgtagagaactgtctacttaattagtaaagtgttgcacatgcgagatgttcaagctatttttgataaagaagagatattctcaaccaaagctcgtcgaacacaattaaagaaaaatataaaacaaaaatcaatagaagattatattgattcaaatacagaaaaagtagaagaaaatgtcaccacttcagaatctacagatattgatgaagtaaaaaagaatgaatcttctgtatcttctacggaagtagttgaaaatacaactttggtgtcagatgttgctgctcagagtagtagtgttatttctaatttagcttatctcggtggagggattttaggtgttggagcggttgtagcagcaataagtcaaggtggaaaagnnnnnnnnnnnnnnnnnnnnnnnnnnnnnnnnnnnnnnnnnnnnnnactggcggtaatgacatcatttttgctcagttgactactcatttagaattgtccgaaaaacactttggtattatttgatgagaagtaagggggagactggattagaaagcagtcaccccctttgatttttagtaaattaggagcatttttatataaacttaaccatcgccctgaccacagcttctggtttttctgcgtgaacccaatggtctgcaccgctaacaataaaggattttgcttgtgggaattgagctaagatggtttgggtgtctttttcttgtaagtaatccgataacgcccctttgataaagagagtaggtttatccacaaaaacattttgccaatccattagattggggtagttttgttttaaacccgatagattaaatttaaagaattctgggctttgtggatcgaatgatttcagcataaattgttgtatgccttcatcttgaataccttttgcaattgctgttttggcttcttggcggttagctggttgggcggctttgacggcaaaaagtcctgcaaaaatgtcatcgtggcggttgaggtgataagcaacgggggcaatgtcaatgatgattagttttgcaacaagctcaggggcgatgttggctaacatcattgctgtttttcctcccattgaatgcccaacgagaataacattgttaagttgtaagtggtcgagtagatctcgtagatcttctgccattaaggtatagttcatttcatcactgtggaaagattgcccgtgattgcgtaagtcgatgcggagtagattaaactgttccgcaaaggctctggcaatcacgcctaagttattcatatcaccaaataaaccgtgaataaagaccattgtttgtggtgatgaagtcgctgggttggttgctgtttgaaattggtgatgaagaaacattttttccgccataatttaattaaaatttattcaattatcgtgtttagatcctgttaaaaagatcggaaatgcgtataatgcctagaattttacagtaatcaagttatttaggggacaagatgaaaacaatcgaagttgatgatgaattataccactatattgcaagcagaactcaggctattggggaaagtgcgtcagatattttacgtcgtttactccgtttaccagcatctccccaaccttttgtacttgtgcaagagaatatgatcaatgaattgaaagatcttgcaaagctgcctaagcaaaagaaacaactccatcaacaagataaggtgattaagcaagttgaatttgtgttggcttcgagcctttttaacaatgaaacaaaaggcgtaaatcgctttttatacttgttgtctgccttgtataaagcagatcctgagggcttttctcatgcgacggaaaatgtgcagggcagtgagcgaatttattttgctcgtgatgaacaaactattcttgcgacgggttcgagtgttaaagcgaagcaaattccagagtcgccattttgggtgattacgaataataatacggaacgaaaagggattattttgtgtgcattaatgaatgcaatggaattacctgaagagttagttgctcgtattaaagctcaattcaattaatctatgtcaagggtagtatttccgacattccccacaatatattgggcagaaaaacaggctcaagatattgctattgtttgggatagaggaaatgctaccttgttttcttacttaccccgtcaaatttcgtggcaacagttgcaactgttgattgaacaagcggtgagattgcttgagcagttagcgttgccgaatagcttggtggcttattcaggttcccaccgtttaatcggtttgctctgttattgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgtgttggcaagtggcagaaagatcttaacgcttaatcctgcaatgagcgagagccaacgccaacagatattgcaacaaaaccaagtatctattttgctgaccgatcaggatttttattctctagataggggggttcagttatctagaaatcaagacaatggcttattttctttcgataaaccagccacttttacccttacgtcaggttcatcaggcaatcccaaagcggtagtgcattctattgctcaacatcttgccaatgcaatcagtgtctgtgattttgttcaatttgatcgccattgttcttggttgttaagtttgcctctttttcacgtttcggggcaggggattgtttggcgttggttatcgcaaggggcaatcctttatctgacggaagataaagcggaattttggcaaatgttatcgcaagtcagccacgcttctttagtaccaacacaattacagcgttatttagcttggcttggtgaaaagttagtatcacagcatattttattaggtggctcggcaattcctgcagagttaattcaacaagctcaacaacatcaaatcacaacttatgcaggttatggaatgacagaaatggcatcaaccatttgtgctgttaaaaatgagagtgataatgttggcaaaccgttagcaaatcgagaagctaccctcgtagagggggaaatttgggtaaaagggcagagccttgcgttaggctattggcaacaaggtaaaattgttgccttacacaatgctcaaggctggtttgcgacaaaagataaagggcgttggaatgatggcaaattggaagtgctagggcgattagataatatgtttatttcggggggggaaaatattcagcccgaagaagtggaaaaggtactacaaaaatatccgcttgtgaaacaagtttttgtggtgccagttgccgatcaagaatttggtgaacgccctgtggcattagtggcttttagcgaaccttttacgatacaagcggtcaatttgttgcaatcttttgcaatgcaacgattagaaaaattcaaacagccgattgcctatttctccttggaagatgagataggacaatcaaatggcattaagatgtctagaacccatttaaaagcgtatatcgccaacaagttgagagaaaaaaatgtgtaaaaaatcattttggcttgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttatgtttatcttttttcacggcgacggttcagtctgcggtggaagattttgtgtctgcggaagatttgaaaacgcagttagaagcaataaaaaccaatccttctgagcaaacaactgaaccggtcaaaaacattgaagaagccttgctattcattgagaaaactaaaaatcaaaatagtgaattagaggctttagaaaaaaaacttactaatgcaactgcaactttagatacttataagaaaaatatcgacaaattaactaaggagttaaacagtgaagttgaaatttccagtaaactcagtaatgaagagttagaaaaacgtttagacaatacccgtcaagagttaaacaatgttcaattgaccttgaatgaaacaaactctagtgcggtaacttatcgtacagcctcagaacaaacacgaaaacagattaccgaaaataatcaacaagcggataaattaacacgtttaaaacacaataaccaagcaagtaaatcgctgattgataaatacaatgcggaattaaaatacctagaggcaagtaataaatataatcaatatttagcacaaaacattgatctgctgatttcgttgaaagaggcgaaacgtaatgaattaacgttaaaacagcaattgttacagaaacagcaggcaacgttacaggaagtcttaaatgccaagcgtttaaaagagtttgaggctcaagcaaaacaggctgaagaactaaaagctaacaataaagttgaaaatccgattattcacgatgagctttcattaaacaccgatttaagtcaatttttggttgaacagacacaaaaaaccaatacgttgtcacgggatagcctgcgtgctaaaaatgtactagacagtttgatacaaacccagcgaaacattgaagagcagatcagtgcattacaaggtactttggtgctatctcgtattattaatcagcaaaaacaatctttgccaacagatagcttaattaaagggctttccaaagatattgcaaatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcaaatttacgggtagaaatttttgatttatcgcaaaaacgtgatgaactctataaccttaatagcgttatcgaaaaattagaaacgacccacaaaaccctatttgatgatgcggaacgcaaaaccttaacagacatcttaaaagagcgtgaaaaaattttagcggacttaattaaaacgcttaatatacagcttaatttgtctaatgagattgagcaaacacaaaagcagattatcaccatcagtgataccttgcaaaatcagctacaacaacaaagtttttgggttcaaagtaataacccgattgatttaacttggttagaaacctttccaaaacaagcaattgctgagatttcaacattaacggactatcttggctttgaaaatttggggcagaatttgccttcaaccctaacttttattgcgattttgttatccctttatggcttaattatttggaaaaaaacagacataaaacaccgcttggcaaacaccgcttggcaaccattggtggccatgttaataccctaaaaaatgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccatgttaataccctaaaaaatgatagccattggcatacaccagaagcgatgttttggacgatagtattagccttaccaagcggtttgatgtttttgacccttgcaactgtggcactttacctatttgtgcctgatccattattagcttcaacttgggtaaccgaagcctttgaatattggttattttttgctaccgttttatcactattgcgaccaaatgggttagcttatcgccatttcggtatgccacaagcaagtaacgaaattttccaacgcattattaagcagtctgtgtggattgtggtgttgctcttagtttcctcgattttctctcaaattgaggtggtcgggtttactaatgatgtgatcggtcaagtcgtgacgatagttgctttagctttgtgtacttttgttgtacgccctctattagatcggggtattcaagagtatgaaaatgctaaaacggaagatggtaaaaaacgcagtgtcagcctgtttaaactcttgcgttttgtgctgtttatcgtaccgcttaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgattgtgctgattgtattaggttactactacacggcagtttatttaatcgaccacattattacgacctatttagtcgcattagtttgggtatttggacgctactttgcttatcgttctttaactatttcttcacgtcgaatggcataccgtcgcttacagaaaaaacgggaaaaaatcagagaacaaaatttagaacgtttagagcagggggctaaagaggaagccagagagaaaccagaggaaatcatcaagatttcaacggttaatgagcagattttccgtttagctgatttaatcggctgggtgattttattcgtatcgctttatgcgatttggtcagatttaatcagtattgcttattatctcaataatgtgattttatgggaaaacatcgaaactacctctaaaggtacagtggtagagtccatcaccttattgaatattttacgttcgatactttatattaccgtcacctatgtgctggtgaaaaacctgaaagggattttagaagtgaccttcttctcacggattaaactatccaaagggacaccgcatacgatcactgcggtaatgacctatctgatggttactttcggtagtatttctgcctttaccgctcttggcatttcgtggagcaaaatccagtggattttcaccgcattatctgtgggtcttggtttcggggtgcgtgaaattttcggtagtttcgtatcgggtaccattttattatttgaacgtccaattcgcgttggtgataaagtaacggttggcaattttacaggggtgatcagccgtattcgcctacgttcaacaactttgattgatgatgataacaaagaagtggtactaccaaaccaagcctttgtgacagatagatttattaactggacctttaataacaccgtcacacgcttacagtttattttgaaaatcagcaccgaagcagatttatcactgattcgtcgcttgctaaaccaagctgcaagcgaagcgccaaaagtaatggtggaaccatcgccaagtattaatttacaaagttttggtgatggctggatcgaacacgaatttaccgtatttgtaccggaattagacgatcgtgccgcaacacgcaatttcctctatcagcggatcacagaactctttaaccaacaccaaattaaaatgaccttcaatcaaatggaagtgcatttaaaaaatggtataaatagcgacatcaaatgatttgtaggggcaaatcatatttgccccaaacaatttttggaatatcagatttgtagggtggggttttagcccaccattttaaaacctattgattttatacccaacaataaaaataaggaaaacaaatggcaggcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcattggacaactttttaaagtcaccacattcggagaatcacacggcattgcattaggctgtattgtagatggcgttccccctaatatggaactcagtgaagccgatttacaacccgatttagatcgccgtaaacctggtacttctcgctataccacaccccgtcgagaagatgatgaagtccaaatcttatcgggcgtatttgaaggcaaaaccacaggtacaagtatcggcttaatcatcaaaaatggcgatcaacgttccaaagattacggcgatataatggacaaattccgcccaggacacgccgattatacctaccaacaaaaatacggtattcgtgattaccgtggtggcggacgatcttctgccagagaaactgcaatgcgtgtagcggcaggggcaatagcgaaaaaatatttaaaagagcagtttggcgtagaaattcgaggctacttatcacaaataggctcagtcaaaatcgacccacaaactgttgcaaatatcgaacagattgattggcaacaagttaatagtaacccgtttttctgcccagatcctgtggcagtggaacaatttgacgaattaatccgagagctgaaaaaagagggtaactctattggggcaaaattaaccgtgattgcagaaaatgtcccagttggtttaggtgaacccgtatttgaccgcttggacgcagatctagctcacgccttaatgtcgatcaatgcagtcaaaggtgttgaaattggcgatggttttgcagccgttgaacagaagggtagtgaacatcgtgacgaaatgaccccagaaggtttctgctcaaaccactcaggtggcattttaggtggaattagctcaggtcagccaatcatcgctcatattgccctaaaacctacttcaagtattaccgtacctggaaaaagtgtgaatgtacataatgaacccgtcgaagtagtcaccaaagggcgacacgacccttgcgttggtatccgtgctgtgccgattgcagaagcaatgatggcaattgtggtgttagatcatctattgcgatttaaggcacagtgtcgttaattgttaatcaagaacgccatttggcgttcttaatataggacacgaagcgtcgtgtcctatatctccacaatcccctttaataaacagccctcataaatgcctaatttaattgcaatagaaggaatgagagggctgtcccaatcgtattggctggtgacaatatcaattcgtagttcattaagaagcaagttttgctgtagtttggtttgcagttgttcaaaaagtggttttttaatgcgtaatagcggtgagttcaacataattttttccgtagaaaatatgttgattaggttcatcagcatataagcaaggttgtcggtaagatgcgataaaatctgcattgcttgagggttttcggcttctacttgttcgcagaagtagttgattttatcttcaaggcaagtgtgttggtggtcaaaatagcggtcgatcaagttggctagggcagggaaagtcacttgattggtgagttgataacgttcgatttctgtctgttgttcagcaatttcatcactaagtggactgaattttggcattatcattttatcaacattcattcgtttatgttcgtcttgatggagtaatgcccctttgagtaatacacttaaattcacttgatcatcaagctgtaagaaaataacgttgtcattggcaattaaacttcctaaggttgcttccgctagaagccagagttgaaaatgctcgttgagtaaaatcggttgattaaagtgacgatgcaatgtttcaacgagagggcaggtgaggggctgttgccctaattgcgtgataatcgtttttgtgcggtcaattttccccactacgctgatagaaatggcaagcaaagcttcgttggtaagcggtgtgttgagggaaaaagtttgtatgcagttcaggatatgctgatctaagctaagatattcgtcggaagtcaggctataatgttgttggtaaatgagcttgccactcaaatcgcaaagtgcgatagagagtttttgtggtgcaagggttaagcagagataacgccagtggaacggggaaaccgacagccctacggcaggtctgccccttgagggtaaattttgtgaggttctttctaaaatcagtttatggtcaatgagtattttcgtcagcactgtcattgatgcaggggcaaatcctgataatttcgctaagtcagtacgagaaatcagctcaaattgttcaactaagcggtaaaccgtgccgagatgttgatatttataatccgaagaggtgattttcatagctataatccttacaatctttttactccctaagtcgttactttattgtgctatttttataatgtgtctggcaaattgtttccttcaattatgagagtgatgtcacaaaattattttattttttaaaataaatggtggaaaattacgctaactcgtggaaagtattagaaaaaatgaataagtatatagaatatcagtgggttgatgataatcctagtttggctcagatgtgtctgcaggttgcagaacaatcggtgattgcattagatactgagtttgttcgtactcgaacttattatccgaagttgggattaattcagctttttgatggtaagcaggtgtatttgattgatccgttaagtattacggatttttccccttttacggcgttgttagcaaatgaaaatgtgcttaaggtgcttcacgcttgtggtgaagatttggaggtttttcaacactatttcaaacagttaccgcaaccaatgttagatacacaggtaatggctgggtttgtaggtttaggtatttcaattggctttgccaaacttgcgttgcattatcttgaggttgaattggataaaggggcttcccgtacagattggttgagccgtcctttgagtgagatacaacttcaatatgcctgtgcagatgtgtggtatttgttgacgatttatcacaaattggcggaagatttggcaaaaacaccgtggcaaactgctgtcgtagaggagtgtgcaaccttgttagctaaacggcagatcgtagaagatccgaataaagtctataaggagatcagtaatgcgtggcaacttaaccaacaagagctggcaattttgcagatattagctaagtggcggatagaagaagcagaaaaacgtgatttggcattaaattttattattaaagagcagagtttgttacaaattgctaaattacaaccgaaacatacttcaatcttgttggaatttatgcacccaaatgaagtgcgtattcacggtaagaaaattttgtggttagtcgagctgggtaagcaaattttgccagagaactatccgcctgttattcgtcgtttggttgatgaggctggctacaaaactactttcaaacgcttgcaaaagcgtcttacagaagtttgtcctgaaaatttggcgattgagttgttggcgagtaagcgtcaattaaatcagttgtttaaatggtatagaaatgggcaggataggcaaaagttacctgagttattgtgtgggtggagagagcaattcggtaacaaattattgccagaaattgatctaagtaaataaaaacatagagaaatgttttgtgatgtaaagttgctatatttttactaaatgaaggagtaccatgagttgtagtatcttaggtaagtgtacatccaaaatcatttaaaacaagcggatactttgatttgcaagttggcnnnnnnnnnnnnnnnnnnnnnnnnnnnnnnnnnnnnnnnnnaaggatattttcctttaaaatcaaattgctacaagtgttaaaatgaaaatatccttataaatcaattggttatatcctattctgttcgcataacgtatattatgttaaatgacaaatttaagcggataaatttaagacttttctttcttttttctcttcccttttttactgagatcaatttattttcaagtgtaaaaggcgtatcataggcacgcagtcacgtttacccaaaacgtgttaattttttcttatcacataggtgtttcgacaatgtcaaaaaatattcttattcttaactgtggtagctcatctttaaaattcgctatccttgatcctgtttctggtgatgaaaaattatcaggtttagctgaaaactttaatttagttgacgctcgtattaaatggaaattaaatggtgagaaaggtgcagcagatttaggtgcaggtgcggctcacagtgaagcacttaactatatcgtgaaaaacattttaagtgcagaattaaaagacagcattggtgctatcggtcaccgtatcgttcacggtggtgaaaaatatacttcatctatcgttattacagatgaagtggttgcaggtatcaaagaagctgcagcatttgcaccacttcacaaccctgctcacttaatcggtattgaagaagcattcaaagcattccctgaattaaaagagaaaaacgttgcggtatttgatacagcattccaccaaacaatgcctgaacacgcttatctctatgctcttccatactctttatataaagaacacggcgtacgtcgttatggtttccacggtacaagccactattatgtgagccgtgaagtcgctaaagttgtgggtgttgaaccgtcaaaagtgaacgtgattacttgtcacttaggtaacggtgcttcagttgctgcaatccgtaatggtaaatgtattgatacttcaatgggtttcactccattagaaggtttagtaatgggtactcgttcaggtgacttagaccctgcaatcattttctttatgcacaatacgttaggtatgtctgtaaaagaaattgaagaaacattagtgaaaaaatctggcttattaggtttaacggaagtgacaagcgactgccgttatgcagaagataactacgcaactcacgcagatgcaaaacgtgcaatggacggtttctgctaccgtttagcgaaatacatcggtgcttatatggctgttttaggtgacgatcacttagatgcaatcgtatttactggtggtatcggtgaaaacgcaggcctagtgcgtgaattaaccttaaattacttaaaactgttcggtattaaagttgatagcgagaaaaatacggcagcacgttttggtaaatcaggcgaaattactgctgctgattctgcattccgtgcattcgttatcccaacaaacgaagaacttgttattgcacaagatacagcgcgcttagcgttataatatctaaaacctgccagatggcaggttttttactttttacatcacaaaagcggtgagattttgcaaaaaatttgactactctacccgcttgtaacaaggaaaaaaacaatgtccagaacaattattttaattccaatcagtaccggcgttggtttaaccagtgtaagtcttggtttagtccattctcttgaacaaaaaggggcaaaagttggtttcttaaaacctatcgcacaacctattagtggtgaagatacccttgaccgttcaaccactattatccgcctttcacaaagtaccgaaacaggcacaccatttatgctaagtgaagcggaaacattgattgcaaaaaaccaaaccgatgtattacttgaaaaagtggttgagcgtcatcaaaaactcaccaaaaacagtgatattgttattgtggaaggcttaattccaacgcgtaaaaactcttacgcaaatagcattaactatgaaattgcacaagcattagacgctgaaatcgtgttagttgcagcaccggcagcagacaaaccagcacagcttaaagagcgtattgatgctgcagtttctttatttggtggtcgccacaaccctaacctactcggtgtggttatcaacaaatttaatgcacctgttgatgagtcaggccgtacacgcccagacttaaccgaaatcttcgactcgttccaacacagcagcaataacattcttgaaatggaaaatctgttcaaagctggtccaatcaaattactagcttgtattgcgtggaaatcagatttaattgcaacccgtgcaattgatgttgtaaaacacttaggtgcggcaattattaatgaaggcgaagtacataaacgccgtattcgtagcgtaacattctgtgcaagaagcctaccgcatatggtcgatcactttaaagcgggcagtttattagtcgcttctgcagatcgtcctgatgtcatcgttgcagcttctttagcagcaatgaacggcgtggaaatcggtgcattactcttaacgggtggctacaaaattgatactcaaattaccaaactttgccaacaagcctttgagactggcttaccaattttccgtattgaaggcaacacttggcaaactgcattaagcctacaaagcttcagccttgaagtaccagtagatgataaagaacgtattgatgcgattaaacaatatgtctcagaacaattcgatgcaggctttattgatggtatttcaaaaggtgcagttcgcgctcgtcgcctctcccctgctgcattccgttatcaattaaccgaacttgcgcgtgaagcgaaaaaacgcattgtgttaccagaaggtgatgagcctcgtaccgttaaagcggctacactctgtgcggaacgtggcattgcagaatgtgtacttttagcgccacctgcggatgttcaacgtgttgctgaagctcaaggggttactttaggcaaaggcattaccattattgacccagctgaagtgcgtgaaaactatgtagctcgtttagtcgaattgcgtaaaaacaaaggtatgactgaggttgttgctcgtgaacagctgttagatactgttgtactcggtacaatgatgttagaagcaaacgaagtagatggcttagtttcaggtgcagttcacacgactgcaaatacaatccgtccaccaatgcaaattatcaaaacagcaccaggtaactctattatttcatctgtgttctttatgttattaccagatcaagtacttgtttacggtgactgtgcggtaaacccagatccaacacctgaacaattagccgaaatagctatccaatcggctgaatcggcaaaatcattcggtatcgatcctcgtgttgcaatgatttcttactcaacaggaacttctggtgctggtgcagacgtagaaaaagtagctgaagcaactcgtattgcgaaagaaaaacgcccagaccttattattgacggtccattacaatacgatgcggcaattatggaagatgtggctcgctctaaagcgcctaactcccctgttgcaggtaaagcgaccgtattcgtcttcccagacttgaacacaggtaacacaacttataaagcggttcaacgctctgcggatctcgtgtctatcggtccaatgctacaaggtatgcgtaaacctgtgaatgacttatctcgtggtgctttggttgatgatattgtttataccattgcattaacggcaattcaggcgactcagtaaaaaataaactgctagttcaaggactgaatccagttactactggactcagtccgtttaaatacgtcagttatacagcccaatatattattctttaggatatacagcctctgttagaataattcttttgcctcttgaagcaatgattctggtattgaaagtcccagttgtcttgctgttttttgattaatggataattccattttacttacagactgggttgcgatattacctgctttttcgcctctgaggatttttgctgcaactttacctgtttctgcaccaatatcatattgattcactgcgtaagcagctagagctcctctttttacagtgtctttatccgcagcaataacaggaatttttgcttcaagtgctgctttgtgtaatgcttcataggcagatactacagcattatcttctgtaatataaatagcttgcacctttccacttaaactacgagcagctgtgccaatatctgcactacgctgcacagctacaggcataatctcaatattagaacctcttattgcattccttaattcttctaacacaacagctgaatttacctctcctgcactgtaaacatatccgagagctttaatatttggtactagtttttggattagtgccaattgtggttcaattggtttatgatctgaaatgcccgttacatttgttttacttggttcccaagatttaatcaacttggcagctacaggatctgttacacctgaaaatacaataggaattgaacgtgttgctgcaacaacaggttgagcacttggtgtcgaaataggaataataatatctgttttatcgcctacaaatttacgtgcaatttgagctgcagttgatgtactaccttgagcagattggaaattaatactaatattttttccatcaacaaagccttctctagcgagttcttcaataacaccctgtcgaatagtatctaatgcaggatgctctacaattgcagtaattgcaacattatggattttatcttgtgcagatgcattaaatgcgaaagcagcaagtgcagaaaaaagaattgtttttctcaatttcatatgaatttccttaatttaacttgatgtattaatgtactattaaagtagtgcggagaaggatataaaaattaatatactattgcaagaaaattttaatcgaaataaggaaataatataataaacgtttgttttttaaactagacagaagggggaatgcactacttccccctcagataactcatttaaccaactttaaatgagatgattttttcttagtaacttttttgagtgactgcgctctatttactctatctaaatatgtgtcttcttgatagaaagcttcttcttgaaacattacaccgtcaccattttcctgtgcataaatagcctcgacagcaccgaatggaatataaactccacgagcaattccctgaaatcttgcattgaaactaattgcttcatcagtaacaacatattgtcctatagagcggggagaaatatttaagataattttaccatcacgcacaaattcttggggaacatctgtatctacgtactccgaatttattaataaatatggggtattttcattatctaaaatccaattataataggcttggtataaataaggtcttaaaggtttcatatcagtctttatcatccattaaatttttgggtgtactacctccaatagattgcacaaagctatctcgtttaaaaactctattcatatatgctttaaccgcttttgagcctgccccattaaattctacacctagagtattcattctccacaataaaggggctacatagcaatcaactagactaaaatcttcactcaaaaaataatcagaatctgaaaatactggacctaatgctaatacttcttcgcgtagctgatttaatgctctttgagcttcagctgtagttggatcacgttcaataaaatcaattaaagagaaccaatcattttgaatacgatgtatatttaaacgacattgagctctcagtataggataaacaggcattaatggcgggtgaggaaatcgttcatcaagatattccataatgattcgtgcatttgataatatgagatcacgatcaaccaacactggcacagtacctctaggattgacttcaattaaatcttccgaaattgtgcctggtaaaatattttcaatttcataagcaacgcctttttcagctaaaacgatacgcacttgatgactataaatatctgttttagtagaaaaaagcgtcggaacagaacgtttatttgcactcatcatttatttctcccaatatttaaattttctcaatattcgatcttccgattttagcatagattatctgttaaataacagtgctatttttcttatccaatatcctttacttaggattgatttagagcaacttcttgaaaatttttatataaaccttttgacgatagagtataaaacgtctagcataacaggaatcttttatcaaaatagaggaactatagatggaaaatagcaaaaaacaatcatttcaagatatgctagattatgtgcatctttatcgtttaaaaaataaattattacgtgaaacagcagataatgatcgcaaaatccgtgataatcaaaagcgtattttattacttgataatctaaatcagtacattactgacaatatgtctatccaagacatacgtgtaatcataggtaacatgagagatgactatgaaaaccgagttgatgattatgctatccgtaatgctgaactttctaaagagcgtcgagaaattagacgtaaaatggctgaacattctagtaaaaagtaaatgaacagaacggtaagtcgccaaacttaccgtttttcatatcctactgttcaatccacatcacaaaatctgcaacagtatgaaatgaaccaaacacaagaataatgtcttgttcgttcgctgtttcaaaaagaacttggcttgcttcaataacattttcataggcaacggctttggcgtttggtaaggcagtaagtaatttactttttacctctgtgccactctgcccacgataaccttgtagcccagcacaatgccattcgtcaatcaactcttccaaaggctcaacgatacccgataaatctttatcaaccaatgcactaaacactgcatatattttgcggtttggttgaatccattctgcaagacgatccgctaaataacgtgcagcgtgggggttatgtccaacgtcaataatcacctgtgcaagcggtctattttgtgaaaaagttgcaaaatcttgttcgcctaataattgaaaacgcgctgtcatctgtgcctctgcaaccgcttgaacaagaatttcatcactgagttcaaaaggtaactgggttaaaaccgccaaagctgtggcacagtttggctgtggaattttaggcagtggaacagttaaagatttggttttcgattgccactgcaagcggtcagattcgacggaaaatttccaatctatatctcgtctaaaaacgtgacattgcaactcttttgcatggtctaagatactttgggggcaatcagactcgccgataactacaggaatatttgggcggaaaatccccgctttttcacgacctatcgcttcacggttatcgcctaaaaactcaacgtggtcaatatcaatcgaagtgattaccgcaaaatcaggatcgacaatgtttgtggcatctaaacgcccacctaatcctacttccaaaatcgctacatcaatctttgccttacggaacagatctaacgctgctaaagtaccgaactcaaaataggttaaagaggctgatttgtgctgttcaatatagtcaaaagttgtaattaaatcagcatttccgaccgcttgtccttgaatacgcacacgttcgttatagtggattaagtgtggtgatgaatagaccccgacctttaaacctgcttttaataacgccatttctagcaatttgcaggttgaacctttgccgtttgtacctgcaacggtaatcacataaggggctggcttgagtaaatccaattcttccgcgacttttcggatacgttccaagcccatatcaatcggtttgaaatggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaagccttcaggcaatttctcacgcacagtttgttcaatcactcgtggacctgcaaaaccgatcaaggctttaggctctgcaatattaatatcgcctaacattgccaaacttgccgatacgccacctaaggttgggtctgttaaaacagagataaacggcacgcctttttctttcatttttgccaatacagcactggttttcgccatttgcattaatgagaataacgcttcctgcatacgcgcaccgcctgaagcagagaaacagataaacggaatattctcgcttaatgctttttctgccgcacgaacaaattttgctccagcgacagatcccattgaaccgcccataaactcaaagttaaaggaagcaacaaccacaggcatatcatatagcttgccatacattacgatgaaagagtctttttcgcctgtttgtttttgagccgcagttaaacgatctttatattttttgagatctttaaacttcaacacatcttgtggttcaagctctgccgctaattcttcagcagtatcttggtctaaaagggataataaacgtgtacgcgcatcaatacgcatatgatgatcgcattttgggcaaacttgcatattgcgtttaagttcttcactataaagaacctgttcacagcttgtacattttgtccaaacgccttctggaatttttgatttaccacttgatgatgaagacgtttttcctaaaattttttcaatccagctcattgttacaccttaattgtgttgagaaaattgggcgtattaaagcataaaattatataaaaatacatatgtaaaatagccctagatgttttattgtggatcaattaagtcaactaatttcataatgacttcgtcaattaaataatcctctgctttagtcgcatacttagcttgacgttcttttaaatctaaggctcttacttgatgacataaaataacccctgttaccttacctgattctgtactactaccatcaagcacaacggttacattctgcgaacgagtcgcattgccacccgtagatattgggcaacaaattgctgtgcctaatgcttgattcaataattcgtctgataccacaatgaaataatggggaaagcgaagctcgtgacctttcgttggatctggatcaacataccaaatctctccttttttcggaacacgcattaccatacttctttcccagtgggttgagattgggtaaattctgccactgttgtgttcaactccgcaatttcttgactatcaatacctgctaacaattctgcaactgtcttacgacctcgtgcttgacgcttaataggggtgagtatgacactttctccccttgtctccaaattgactttatgaccaatttgccaccccatttgttgcaatattgccattggtacagtcaagacagcggctccaccttgttgtcttaatgtcgcttgcataactacctctctcagtgttactttgtgcaacattatagagcaatttatctcacattcaagtgatgattgtgtgctaatttatttctgcttgttcaaactgtaaaaagaatatcgtagcttggaatatttacatttttattctattcgcaaataatttactaaaaatcaccgcttgccccttgccaaaaggtataaatcctcgtataaatccacctatttgcaaacacatattaaaaggaaaactatgtcaatgtttaaccacattcaagcagcaccagccgatccaattttaggtttaggcgaagcatttaaagcagaaactcgccctgagaaaatcaacttagggattggggtttataaagatgcgaaggggcaaacgcctatcgttaaagcggtaaaagaagcagaaacgcgtttactggctaaagagaataccaaaaattacctaacgattgacggtattgctgatttcaatgcacaaacccaagagttattattcggggcaggtgcggaagtaattacctctggacgtgctaaaacggcacaaagccttggcggtactggtgcgttacgcattgcggcagaatttgttaaacgccaaaccaatacacaaaacgtatggatttcaaccccaacttggccaaaccacaatgcaattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtctgcggaaaaaggttggttgccattatttgactttgcttatcaaggctttgcaaacggcttagaggaagatgcctttggcttacgcaccttcgtgaaaaatcaccgtgaagtgttagtggcaagctcttactctaaaaactttggtttatacaacgagcgtgttggggcatttaccttagttgcagatagtgcagaagtggcaaataatgcgttcagccaagtaaaatcgattattcgtgtactctactctaacccatcttcacacggggcaagtgccgttgcgacagtgttagctgatccacaattaaaagctaactggattgaagaactggctgaaatgcgtaaccgtatcaaagagatgcgtgcaaaatttgtggcattgttgaaagagaaaggtgcaacccaaaacttcgattttatcattgcacagaacggtatgttctcgtttagtggcttaacccctgaacaagtggatcgtttacgcgatgaatttgcgatttatgcagtgcgttcaggccgtatcaatgtggcaggtattaccgaagataatatcgacgcattgtgtgaagcgattgtaaaagtactttaattttaaatgcatagtagacaagcctttatactttaattatttttgtctgctatgctcgtagtttttcaggagagaataatataatttactctctcttttcctttaatgtaataaccccaatgccatactcgccccaacaatcacaatccctgcaaacacaagttgcattgatgaaatggtttcacctaggagcagataagcaataaatgcggttgagatcggcattaataattcaagtacttgataggtgatgataccctgtttctggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgatatgaaacaatttgatgcaatcatcattggggctggcgcagcaggtttattttgtgcggcacagctcgggcaagggggaaaatcagtactggtgctagataacggcaaaaaaatcgggcggaagattttaatgtcgggcggtggcttttgtaatttcactaacctagatgtcacccctaatcattatatttgccaaaatcgccatttcgtcaagtcagcgctagctcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactgttctgtgatgaaagttcgcaacagattgtcgatctgttacaagctgaatgtgagaaaggcaaagttgatattcaacttcgacaagcggtcaattccatcgaaaaatctgcaaattttttccacattcagaccgcttgcgaaagctatcagacggaaaatctgattattgccacaggtggtttatcaatggctggcttaggggcaagctcattcggttataaaatcgccgagcagtttggtattcccgttatccccgttcgtgcaagccttgtgccgtttacttggaaagaaaacgataagatttttgccaccttatccggtatcgctttacccgttagcgtaagcaaccgtaataaaacctttagcaatcagatgttgtttacccatcgtggattatctgggcctgctattctacaaatttcaaactactgggatttgggtgaaacggtggaaattgatttacttccgtccgcctctatccttgatattttgaacgaactgcgtcaatcttcgccgaaattgcagttaaaaaccgtattatcccgctatttaccgaaaaaactagtcgaactgtggattgagcaacagatgatcaaagatcagattatcgctgaactgaacaaagctgatcttgcctttttagatcactttattcatcactggcagtttttaccaaacggtactgaaggctaccgcacagctgaagtcacaatgggtggggttgataccgattatatttcgtccaaaacaatggaagcgaaaaacgttcagggtttatattttatcggtgaagtgcttgatgtgacaggctggctcggcggctataatttccaatgggcgtggtcgtcggcatttgcttgtgcggaagggctaaaaagtaaatgaaacatttgtagaagatcaattctgatcttctacaaaaactatcaatatttataggagggttacttatgaaagatattttgcttttaattctttcacaaccgctttttgttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaatttgacgagcacggataccgttgacgttgaaggtactaccgattgcaccatctacacctaatacggttgcaggtaacatcatttcatcaaaacctgcatagattaagtggttcgggaacgctttgcgtaaacgttctaatagatagaaatcgcctgcggtgaatttcacaccaatgattttttcattttggaacagttctgcaaattgtgaaacgccgatgtttacccctgttaagaatgggatagagtaaacaatcattttgttacctgtttcacgaataatggtttcgtagaggtttttgatttctgggaagctgaatttgtagtagaatggtgttactgcagataagctgtcatagcctaattctgttgcatatttaccaagttctaccgcttcttttaagtttacgctaccgacttgagcgattaatgcaatgtcatctttcgcttcatcttttgcgatacgaaagatctcttttttctcttccgttgatagcataaagttttcacctgttgaaccacctacatacaagccatcgactttcattttgtcgatattgtaacggataatttggcgtaaacctttttcgttgattgtgccatctgcattaaaagaaactaataatgcactgaaaataccttttaaatttttcatatgggtttccttattaaagtaaagtatagataaatgatagcggtctgtttcacaaaaaaactatcaaactgaccgcttgtaaactacttaagccgttgatctaaaataacactcaacgttttctgtttttgttgaatcgctttttctggttcagctttcactaacaaggcataaattaaatccagtacaaaaagttgggtcatttttgtaccaattgaatccccctgcatatgcccctgacggttaccattgattaacacataatccgcttctttcgtaataggcgaacgtaaattatgggtaatagcaaccgtttttgccccattgtctcttgatatttttagggctttcgtcgtttcttctgaataaccagaatggctaatgccaataacaatgtctccttttttcagcaaggctgcttgcatatacataaaatggttatttgtcacagcagccgcgtgtagcccaattcgcattaatttgtgctgagcgtcttctgctgttagaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcaatttctttaggtgtatcagtttccgcaacgtacgtatctaacaacgtactactctctttttgctgagtagccaattcaatggcaagatcgagtttaaagtctgtataacctttaaatcccaatgttcgacaaaaacgaataaaggttgcttcaccgacatctaattgatttgccactttagataaagaacattggttcaatagatcgggctgagataaaatcgccgtcgcaatttttttctctgttttagttaaactattttgtaacgcaccaatcgtatctagaattttacctcgggctgacattctagcctcctatcatctccactggcactttcaccactaattttttcaatggcttactttcggtcacaaaattgcccggtgtgtgtggctcataaggtaagaaaatagcaaacatattaggttttaaaattacaacatttttatgttctaaggttggtgtaagctgataatcgtcctcatcacgatattcatcataaagtgctaagttaggataggctaaactgtattcaatcgcttcttgacctgatatcaacaattgaatatcaataaatttacgatggagctccgctttttttccttctggggaagaggtttcaaattccatcacattcattcttactccctcttccaaatcttgccaacctaatggcagattaactaaatcaagggttttaagtttagtacatagtcttgcaaagacaggcggaagtgaaagaatataatcatcacgagaaagatcacctaataacatatagcctcctaatgtttcaccgcacattaaatgaaaagattactccataaaaaatagcataaaagaaaatatactccatagagtaaaactttctcgaccaaatgacaaggtataaacctaaaaaatgagaggtaaatcacaatttacttgatttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattggtgctctgggcgagactcgaactcgcacatcctctggacactaccccctcaagatagcgtgtctaccaattccaccaccagagcgtaaattctatttttattgaggaatatcgctattttctgttttagctggagcaacttcttgtttttgctctacgttacttaaatcttcaaattggcttttgggtgccgcagtttgtgaatttaagttgccgataacgaggcttacgctaaaaaagataatcgctaaaatcgctgttgttcttgataaaaagtttgcagaaccagctgaaccaaataccgttccagctgcaccagcaccaaacgaagcaccagcatccgcacctttaccctgttgcattaaaataaagccaacgaggaagattgcaacaacgagataaacaatagtcagtacattaattaacattgtgttctctttaatctgttcaaaataaaattccgcaggttgcggaattaactttcgatggcgtaaataatagctatctttacttttccttgcaagcggattttattaatttctgtgtattcggtttatttttcaacattttgcgtagatttacgggtataacgtgatttagaacttgttgtaagcggtgttattttcgccaaactttgcaaaatctgcttgtttggggagcttaataaacttggcaaacgctggtttaaatctgccataaattgttgataactggcttgttttttgctgatgtctgttagttgcatttcccagtgagctgtcatatcaggctgtgttgcaacatctggcaaggcactaattaaggttcgtcctgcttctgtactatgaatgtttctgccttttttgattaaaaagccacgtttgaataataattcaataataccagctcgggtggcttctgtacctaagccgtcggtttccctcaacacttttttgagctgtttatcctgtacaaagcgagcaatacccgtcattgctgacaacaaggtcgcatcagtaaaatggcgtgggggctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacgatttcatcattatcttctttgcctaacaagaacttccaacctgcaacaacaaggtttctggcttgcgcaacaaaagttccccctgcgatatttaacacaatttttcctttacgatattctgcatcagggcaaaattgcattaaatattgtcgagcaataagctgataaatccgctgttcattctgagttaagtgaacttgcccttgacgtgccgttgggataatagcgtggtgagcttctaccttactgtcattccagcaacggtttttcttattcggatcaacggcatcgggcctttgttcatactcaggtaaatgatgagaaattgccgacatcacttttaggcgatcggcaaaatgttcattcggcaaataacggttgtcggaacgagggtaagtaatcaatttatgggtttcatacagccgttggcaaacatcaagcacatcttgtgcagataagccaaaacggcgagccgcatcaatttgcaaggctgagagtgaataagggagtggtgctgcttcactttccattttatcttgatattcggtaacgcaagcggcttgatcggcgatacgttttaccacattctcagcaagtgggcgagaaagtactcgtccatcttcatcttgataatcttcgcaggctttacttggttgccattgtgcttgaaaaagctcttgggtttcagagacaaccacatttgccaacacttcaaaataatcttttgggataaaattttcgatctcaagatcacgtcggacaatcaagcccaacactggcgtttgtacacgcccaacggaaagcacgcctttataacctgcccaacgcccttgtagcgtataggctctggtcatattgatcccatatagccagtctgcccttgcacgagctaaagccgatgtagcaagcggtacgaaatctcgattaaattgcaatttttcaatcgcttttttgacagcattagggttgagatcgctaatcaaacaccgctgaatttgggatttccgctcaggggataaatttaagtagccaaaaacttcgtccaccaacagttgtccttcacgatctgggtcgcctgcattgactaaaatatccgcttgtttaattaaacgctctaccaccttaaactgcttgagtgtctcttttttggggatcagcttccactgttcagggataatcggcaaatgttccattcgccacattttgaaacgttcatcataagcatcaggttcagcttgttctaacaagtgaccgatacaccaagtaaccacattgtcttcgccacactgaataaagccgtccccacgggtatggggtttcggcaatacatcagcaatcgcacgccctaaacttggcttttctgcaatgaataaacgcataaattgcttatagaccttgtgatgataagagcatttgacaaagttgtggcggttgtggaatagtttttgcttttggtgttgttgatggcggtgcaggctcaaaccaagaataaagttcttcaccacagccatcgccagcaggcactggagcttgattttcacagttcgccgcatctgcagggcaagttaaacgaacgtgaaaatgcgagtcgtgggcgtaccacggacgaattttgcgtagccagttgcgatccgttcctgcggtattacagagtttcactttaatcgctggattgacaaaaatgcgatcaactcttggatctgaagcggcaagtttgagtagttttgtatggtttgccgtccatagacgttcatctaccacattagccttacgatcaaccataatggtcgccaaacctgctggattgcgagcggtttcatcgtccattgggccaaaacgaagccaaatatcggcatctaaccctgtttgatggctggcgtgtccagatgaaaaacgccccccagcaggcatacccatatccccaattaaaatcggtggaatgcctgacgctttagcatttttggctaaggtttttaggtagcttaataattgtgggtgtccgtaataacggtttttgacagaacgaataacttggtagccttcgccttttaatgcgagcggttgagcaccgataatacagccgttgctatatcccccaatggattgagccttacccaccacaggcgtgcggattttttcccattgggttgcaaaagcggtggcggataagagtgctaaacctgaaacaaaggcggttttaatcaatttcattttcttctccagacctatactaatttaatatgtatggtaatctcttccctatcgtgatacaaatgttttgtctgaatagcaaatttcagcccttgtttctctaataacgaagcaatcgtatctcctgcaacaactcgcctactacaatcatttgacgaacaaaaatcaactgattaaaggctaattctctggctaatctatccgcttcccctgcttgatagcactcaaaaattacataaccactgttctctttgagattagcaaacccataaattcccaattgagccgctttatcattgatttcacctgccacttccttttcaaaacctgcacggcagtataaggctaatttattcattacttctgacttctcacactaatataaaccaacgctgcccagcccactaaaaatagtgtaccgccaataggcgttgtccaaacaaaaattcggcttgcccctaaggctaacgcatataaactgccactaaacagcaaaatccctaacgcccaactaccgccaataatgttaaaggctttggctctgcaagcgggcggatttttcgagaaatttgcaatttgaaataaacccaacgccatcaatgctaacgtatgaaacatctgatattgcaagcctgtttcaatccacaccaacgctttctgatctaaaaccttctctaaaccgtgagccgcaaaagccccgaaagcgatacagaaaaaaccacttagggctgaaaaaagaagaaatttgtttttcatcgtatctccttaaaattttcgtgcaatatatcacattcctttttaagccaaaacaaaaggctaagcactttcgtacttagcctttgttggtaatacgttgtttgatgatattaccacccaaatgggcatctattagaccattctttgcacgttgaatggcttcaagcagttgagtatctgtaatatgttgctttgttgcaaataaccgctcgaatgacagcatatcaaatgttaatgggaaaaaatcccacataaaacaatactatactgtctgaataaggatatccgcactaattcccatcttatgatgaatattgcggatcatatttagtgtcaatggtcttttcttattaaaaacttctgatacacgattaggttttccgataataccatctaaatctttgatattaagcccctcctgctccattctaaattttatcgcttcaatcggggtaggtggatcaatcggataatgttttgcttcataattttcaatcaatgtcaccattacatcaaaatagtctaattcatcttgggttagctcatcttctttatcaaaaaaaggttcaataagagaaagggcttcttggtaatcttgttcagttctaagtggtttaatattcatttatttctcctatgcttgttcgtggctatttgcgtctatcttgtcatattcttcgtgagtaccaataaatttaatataaaccgctcctaatttataggcaattgcaacaactaatctatggtggtttcctttaatattaaaaacaactcgtctatcttttagaatactcgcatttctatattgttgtttaatttcatttgcggtttgccaattcgctttttttacttctgaaatccaagcctttaatggttgctctgtttcagggtgcttagtgtaataatccaccaattttgatgttgaaataattcgcataacgatccctctgaataacttacactttatcccagtttgggattttttgcaattcttttaaaccccctgatgtatcttcccactctaaaaccaccgcttgtgtatcgaccaagcacgaccagtgtgtgcgtttatccattactctttttccattaaataaaaataggattagcctaacagaaaccatcataaaaaccttgatatgtatcaaaaggggtttgccccgataaaataacgttgcttaattaaacaatcacataacaaccccttgcttaattgtcattcagttactacaattcccaacattatccgaccccgagcctgttttcctaagtctagcgatatggaaactgtgcctgtaattgattgattacacagggaaagttgagaaatcggctctcctctcatatttagaaaggtgtcacattgcaaatcccaattagaaatgtggggaacgagttcgagcaagctttgatcgaccgtttccaacgtcaatacacttatttacggttgtcgattaccgatgtctgtaactttcgttgcaactattgtttgcccgaggggtatcgtccgccgttgcataaacaaacctttctgtctgtcgatgaaattcaacgtgttgctcaagcctttgccaatttaggcacggaaaaaatccgtattactggtggtgagccgactttacgcaaggattttctagaaatcgcccaccgcctttcacaaacggcaggtattcgccaaattgcattaactaccaacggttatcgaatggaacgtgatgttgagttatggcaacaagctggaattacccatttaaacgtgagtgttgatagccttgagccacgtcaatttcatttgattacaggggaaaataaactcgcaacggtgttaaacggtattgagcgtgcctttgaaattggctataaaaaagtcaaagtgaatgccgtgttgatgaagcaatataccgctaaaggtttggacgatttcctgcgttggattaaagatcgccctattcaaatgcggtttattgagttaatggaaaccagcgaaatggatcactttttccagcaacagcacctttcagggcaatctattttagaacgattaacccaagaaggttggcaattacaacccaaagcgatgtctgacggccctgctaaagttctcgcccaccctgattatcaaggggaaatcggtttgattatgccttatgaaaagaatttttgtgccagctgtaaccgtttgagagtgtcggcattaggcaaattgaacctttgtttgttcggcgaagaaggtattgatattcgggatttattgcaatcggacgagcaacaatttcaactcgaagccagattaaaatccgctcttcaaggcaagcgcgaacaccattatttgcatattggcgatagtggcgtgagaaataatttggcgtcgattggggggtaatctgtagggacacactgcgtgtgtccannnnnnnnnnnnnaaacacagttgctacatcattgatattttacaaagagaaaataatgaacacctttacccatataaaccaaaacggcgaagctaatatggttgatgtttccgccaagcaagataccgtgcgagaagctcgtgcggaagcctttgtgacaatgaaccctgaaacgttacagatgatcatttcaggcaaccaccacaaaggcgatgtttttgccactgctcgcattgccggcattcaagcggcaaaaagaacttgggaactcattcccctttgccacccacttctgctttctaaagtggaagtgcaacttgaagcattgcctgaaaaaaatcaagtgcggattgaatcccggtgcaaactgtcgggcaaaaccggcgtagaaatggaagccttaaccgcagccagtgccgctgctttgacgatttatgatatgtgcaaggcggtacaaaaagatatggtaatcgaacaagttcgcttgctcagtaaaagcggtgggaaatcaggcgattttgtcgctaaannnnnnnnnnnnnnnnnnnnnnnnnnnnnnnnnnnnnnnnnnnnnnnnnnnnnnnnnnnnnnnnnnnnnnaatgattaaagtactctttttcgcccaaacccgtgaattagtgggcgtagatagcttagaggttgaagcaacctttgccacagctgagcagcttcgccaacatttagccgaacgtagcgacaaatgggcattagcactacaagcagggaaattgttagtcgccattaatcaaaccatttcccctttgtctgctgaaattaaagacggcgatgaagtggctttctttccaccagtaactgggggctaaatggaacaaacacttattcaagttcaacaagatcccttcgatcaaaatgcgatctataaatggttgagtgaacaacattccgttggtgcaactaccctttttgtcggcaaagtgcgtgaaatgaatttgggcgatagcgtgtcaggtttatacttggaacactaccctgcaatgaccgaaaaagccttgcgagaaattgttgatgaagcaaaaagccgttgggaactgcaacgcgttgcggttattcaccgtatcggacagctttatacgggcgatgaaatcgtcttagtcggcgtcagttccgctcatcgtggcaacgcctaccacgccaatgaatttattatggactatctgaaaaccaaagccccattctggaaacgtgaaaccaccgaccactgcgaccgttggattgaagggcgtgaaagcgatcaacaagcggcggataagtggtaataagcggttagattttaggaaaattttgcaaatgaatttatatatcgatctccaacttgcctctgaaaatacagcaggcttaccgacggaagctcaatttcaacactgggtggataaagcgttagcaatggaagcgaaaacggcggattaccctgaaacggaaatcactattcggattgttgatgaagcagaaagtcacgagttaaatttaacctaccgcggcaaagacaaaccgactaacgtactctcttttccgtttgaagtgccagaagggattgagttaccgctgttaggggatttgattatctgtcgtcaggtcgtcgaaaaagaagcagttgaacaagaaaaaccgctcgaagctcgctgggcgcatctggcaattcacggtacattacatctgcttggctacgaccatttaaccgatgaagaagccgaagaaatggaaagtctggaaacggaaattatgcagtcgctagggtttgatgatccctatattgcggaaaaaacgattgaagaataatgcgtcatctaacggttatcgatcatctcccatcttcttttgagactgccgatgtcggcggtattttcttacctgattcgccgatatctctccccttttctaatgctaaaaccttactcggtcaagaatttccttatgcagtttatgatatgcgaactgaaggcggagtttgtcttaatcttgacgcattggcgattgtggcaggcactattcaagaaggtggcacgctctatttggtctgtccagaatgggataatttagagcaacaagtcgattttgatgcgttacgttggaacgctcaacagccgattgctacaccgaatttctttcgttattttaaagcgttagttaatgaaattctgcccccgtttacgggggaagtaccctgcgaagcagggggaaggggggaaattgtttttacccaagatcagcaaaatatcttcgataacttaccgcttgatcctgccgatgttcatcttattctcgcctctcgtggtcgtggaaaatcgacattatcgggcaagctcgcagaaaagctctctcagcaatatacggtatccattaccgcccgtagccattcagccttaccaaatttttggaaggggattgaaagtgataaagtgcaattctttgcccctgatcgtttaattcagatgatcgaacagcaaaatatctcaccgaagcaatggctatttattgatgaagcagcgagtttacctttgccgatgttgcaacagttttgtgcctattttgataaagtggtgctaaccacgacaactcaaaattacgaaggtactgggcgtggtttttgtttgaagtttttgccaacattaagccgttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttatttggataaattaattaacttttatcacctactcgcccaagcacattacaaaacaacgccaacggatttgcgtcgtctgtttgatgcacctgatcaacgctatttttatcttgaaaagcaggaaaagttgatcgcaggttgctgggcggtcaatgaaggaggattagatgatgaactcactcaagctatttggcgtggcgaacgccgtccacaagggaatttggttgctcaatatctctgttttcaaggcaatttacctgatgcttgccgtttgaagtctgtgcgaatttcgcggattgcggtacagcctgaatgtcagaagcaaggctatggcaagcggttggtttcgcagattatttcgcaaatgccaccgcttgtcgattttgtttcggtcagttttgggcttacccctgaattattgcgtttttggcaatcttgtggttttagtttagttcaggttacaccaactcctgaagcaagcagtggttaccacagtgcaatgatgatttatccgctctctgaacaagggaaaatatttgctcaacaagcacagcaacagtttaaacgagattttccgctgttgccttttgccgatcgttttcagcatattgctatttctacttccttaaattcgcttattttggatcataacgatgaaagaaacctacaaggatttatttatgctcaacgaacccttactgcttgttatgtcagcttaaagcgtttatatatcaaccacaactcgtttgattttttatcagatatctttactaactctgatgaaaataagaaatcaaaacaaaaacaatgggttatagaacttaaaaataaactgaaaacaatttcatcaatcggaaaaacctaacgaaaccgcttgcgattttgtgaatgcgatcacattttttttgctttttttggagtaaaattccaatagttactatctatagtgacaattttatctcattcagaaatccataaaggagctaattatgaaaaaagcggtacttagtacaatcgcattagcagtaggtttaggtgcagtagctacatcagcacaagcagcggatcgcattggtgtgacaatctataaatatgatgacaactttatgtcgttaatgcgtcaagaaattgaaaaagaagtgaaagtagttggtggtgttgatttattaatgaacgactctcaaaacgctcaatcaatccaaaacgaccaagttgatgtattaatttcaaaaggcgttaaagctcttgcgatcaacttagttgacccatcagcagctccaaccattatcggtaaagcaaaaccagaaggtatccctgtggtattctttaacaaagacccaggcgataaggcaattgctagctacgacaaagcattctacgttggtactaacccacaagagtcaggcgtaattcaaggtgaattaatcgcaaaacactggaaagcaaacccagcgtatgacttaaacaaagacggtaaaatccaatacgttatgttaaaaggtgaaccaggtcacccagatgctgaagctcgtactaaatattctgttgagcaattaaataaattaggtatccaaacagaagaactcttcgtggatacaggtatgtgggacgcagctcttgcaaaagataaagtggatgcttggttatctagctcaaaagcaagcaacattgaagttgtgattgcaaacaacgacggtatggcgatgggtgcattagaagcagctaaagcacacggtaaaaaattacctatcttcggtgttgatgcgttaccagaagtacttcaattaatccaaaaaggtgaaattgcaggtactgtattaaatgacggtgtaaaccaaggtaaagcagttgtgcatctcgctaaaaacttagccgcagagaaagcaccaactgaaggtactaaatgggaattaaaagagaaagtattacgtattccttatgttggcgtagataaaaataacctttctgaattcttaaaataatgatttgtagtttgggggargggatcttccccctattttgtgaggttggatatgacagaaaacacacaacatcaagagagccaagtgcttctccaaatgaccaatgtcagtaaatcctttcctggtgtaaaagcattagataacgcaaacttgactgttcgttctcattcggttcacgctttaatgggtgaaaatggggcgggtaaatcaacgttacttaaatgtttatttggtatctatgccaaagatgaaggcgatattctatttctaggcaaacctgttaattttaaaacctctaaagaagccttagagaatggaatttcaatggttcaccaagaattaaaccttgtccgtcagcgtaacgtaatggacaatctttggcttggtcgctacccattgaaaggtatgtttgtggatcacgcaaaaatgtatcgagacaccaaagcgatttttgatgaacttgatattgatattgatccaaaagaaaaagtggcaaatctctctgtatcacaaatgcagatgatcgaaattgccaaggcgttctcttataacgctaaaattgtgattatggacgaaccaacatcttcactttcagaaaaagaagtggaacatctgttcaaaattattgaaaaactaaaaaatcgtggctgtggcattatctatatttctcacaaaatggacgaaattttcaaaatttgtgatgaaattacgatcttgcgtgatggtaaatggatcaatactgtcccagtaaaagaaacgacaatggacggcattgtatcaatgatggtaggacgtgaattaactcaacgcttcccaccaaaaaccaatacaccaaaagaagtgattttagaagtacaacacctgactgccaaaaatcaaccgtctatccaagatgtcagctttgaattacgcaaaggggaaatcttagggattgcaggcttagttggggcaaaacgtacggatattgtcgaaaccattttcggcgtgcgtgagcgaaaagaaggctcagtgaaattgcacggaaaagaaatggcaaatcacaccgctttagaagccatcaacaacggctttgcactggtgacggaagaacgccgttcaacagggatctatgcgaacttaagcattgaatttaactcattgatttctaatatgaaatcctacttaggttcgtttggattactcagcagtgctaaaatgaagagcgatacccaatgggtgatcgattccatgaatgtgaaaacaccatctcataaaacaaatatcggatcgttgtcaggcggtaaccaacaaaaagtagttatcggacgttggctattaacgcaacctgaaattcttatgcttgatgaacctactcgtggtatcgacatcggcgcaaaatatgagatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcagctcattatgcaactggctcaaaaagataaaggcattattatgatctcatcagaaatgcctgaattattaggggtgacagaccgaattttagtgatgagcaatggtagagttgcagggatcgtagaaacagctaaaacatctcaagaagagattttacagctttctgcgaaatatttataaaagaaggaagtgaattatgtccacacttactcaaactaaatctttagattttcttaaacaaaatgcgatttattttgtattgcttgtgttattagtgatcattatcgcacaagatccaagtttcttaagtttacgcaactttagtaacatcttaacccaatcttcagtgcgtttaatcattgcacttggggttgctggtttgcttgtatcacaaggtactgacttatccgcaggtcgccaagttggtttagccgctgtggttgctgcaacaatgctacaagcaatggataatatgaaccgagtgttcccaaatctaggcgaaattccaattccagtggttattttaactgtatgtgctatcggtgctgtcatcggtttagtcaatggtttagttatcgcctatctcaacgtaacgccgtttatcgcgacaatgggaacaatgatcatcgtctatggtatcaactcactctactatgatgctgtaggttcatcaccaatcgcaggctttgacgaaagtttctcaacctttgcacaaggcttcttccaaatcggtagctttagattgtcttacattaccatctatgcggcgattgcctcaatccttgtttggattatgtggaacaaaactcgctttggtaaaaatatcttcgctatcggtggtaacccagaagctgcaaaagtatctggtgtaaacgttgctcgtaacttagtggttatctatatgatcgcaggtattttctatgcattcggtggtatgttagaagctggccgtatcggtagtgcaactaacaacttaggctttatgtacgagttagatgcgattgccgcttgcgtagtaggtggtgtatctttcgctggaggtgtaggtacagtaatcggcgtggtaacaggagtactaatcttcaccgttatcaactacggcttaacctatattggtgtaaacccatactggcagtacatcatcaaaggtagtatcatcatctttgcagtggcaattgactcgctcaaatatgcgaagaaaaaatagtcatagatagggcttaaaatcttttataatacaaggctttaagctcttttttaaaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatacatttcacaacaattcgctgctaaataatatctatatttttatagcaaatattaccagccttttaccatcgcacctttgaacacttcgttcgctttattgaacacttcttcagattgataggctttaataaaatctttgacaatttccttatctttgttatcttcacgagaaactattaaattcacataaggtgaatttttatcttctacaaagatgccatctttggttggcgtcaaaccaacttgacccgcataagttgtattaatgatagaaaatgctacatcatcaagggtacgaggaagcaatggcgcttcaacttcttgaatctctaaatttttcgggttttccacaatatcgacacgagttgaaagtaagttagtattgtcttttaacttaattaacccttgtttctcaagtagaattagtgctcgacctaaatttgttggatcgtttggtaccgcaattttatcgccttctttaagttcattaattgacttaatttttttagaataggctgcaatcggataaacgaatgtattacctactggtattaatttgtagcctttatctgcgatttgtttgtctaaatacggcttgtgttggaacgcattgacatctaaatcgcctttatttaaggcttcgtttggtgttgcgtaatcggtgaaaatcactaactctaaatcacggtcatacttctctttggcaactttagctgccacttccatgacttcatgctcaggtcctgaaattacaccaacttttaatacttcttttttctcattacaccctgttaaaaccaagatacaaacaaaggttaatcctagcaagtgtttgaaattcatattatatcctctcaataataaaaaagagtgactagtacctagtactaaatcactctcttttatttagttaaattaccagccttttaccacgccatctttgaagtgtttttgagcttcttggaacacttcttcagtttggtatgctttcacgaagttttgtactgcttcacttgcttggttatctttacgaaccacgataatgttcacataaggtgattctttattttcaacgaaaacaccgtgttctgttgcatttaaaccaacttgacctgcataagtgttatttacaaccgctaaatctacatcatccaacgcttttgcagcaacagaagtatcaacttcctgaatttttaagtttttttgattttcaacgatgtctaatgaagtagagaataagttggtattatcttttaacttaattaaaccttgtttttctaataaaattaatgcacgagcaaggttacttgggtcatttggtacagcaatcactgcaccatcttgtaactcagcgacatttttgatttttttagagtaaccagctaatggatatacaaaagtattacccacgatcactaagttatctaaaccttttgatgcagaatctttatctaaataaggtttatgttggaaagcatttgcatctaaatcacctttgcttaccgctgtatttggtaacgcatagtcattgaacaacacaaattcaacttctaaaccatatttttcttttgcaatttgagctgctttttcagcaacagtatgctcaggaccagacattacacccactttaattttttgtgcttgtgctgctggagcaggtgctaccgttggtgcttctgcttttttctcttctttacagccagttaatgctaaagcagaaaccacggctaaacctaataattttttaaagttcataggaaagtcctcttaaaagttatgtttgcaaattaacgatgatcgtaacgttttgcgagattatcgcctattttttggctaatcatcacaatcgctacgataataacagttgcgatccattttacatagaccatattacgatgttcgccgtaactgatagctaagttccccaagccaccgccaccaacagcccccgccattgctgaatagccaattaaagcgaccaacgttagcgtaatgccattgattaaaatcggcaaagattcaggcaaatagaatttagaaaccacttgccaatttgttgcccccattgattttgccgcttccgtcaaaccacttggaatttctaagagtgcatttgacgttaaacgtgcaaaaaacggaatagcagaaacacttaatggcacaatcgccgccgtcgtacctagtgttgtaccaaccagtaaacgcgtaaaaggcaataacaccaccagtagaataataaagggaactgaacgcccaatattaataatcacatcaagtacttgatgtaaacctttatgctctaaaatttctcctttgcctgttaaaaaagcaatgaagccaatcggcatccccacaacgaccgccaaagctgttgcagcaaaccccatatagagcgtttctaatgtggacaacgccaccaattcccacatctttggtgtgagttcattgataaaatcattccacataacctaatacctcaactttgacattattatcaatcaaataaaatcttgcttctgcaatcgcatcgtgattaccttctacttcagcaatcacaaaaccaaacttcacaccacccgcataatcaatctgcgacatcaaaatactaaagtcgattccaaatttcttcgatgcgtgagaaagtaatggtgcatcaacagaacgccctgtaaattcaaatttaatgatcggcttactggttggcgtttgtgtttgagaaagctgttccatatattcctgcggtaattcaatatggaaagtagattgaataaaacgttgtgccaattctgtttttggattggaaaaaatctcactaaccgaaccgctttccaccaaatgccctttctcaatcactgctacacgatcacaaatacgtttaaccacttccatctcgtgcgtaatcaacaagatcgtcaagcctaaacgtttattaatatctttcagcaattgtaagatcgactgcgttgttgcaggatctaacgcactggttgcttcatcacacagcaatacctgcggatcatttgccaatgcacgagcaattgctacacgctgtttttgaccacctgaaagattgctcggataagcatcgtgtttatccgccaaaccaactaactctagcaactcactgactttttgctgaatttgctctttcggcgtatggtttaactctaacgataacgccacattctcaaacacagtacgagaagagagcaaattaaaatgttggaagatcatactgatcttacgacgagcaaggtttaactctttctcagaaagcgtcgttaaatctttaccatcaacaatcacttgcccgatagttggacgttctaataaatttacgcaacgaatgagcgtacttttacccgcccccgaagcaccgataacaccataaattgtaccttttggcacttcaaggctaacattatcaagggcagtaattttcttccctttcacctcaaactgcttgctgatatttttcagctgaatcatagttatcaatccacactttatcaaaaattaaaatctaggctattttagacgtctagattgctatgtcaattcaaaaatgaaattttttattcaaaaatggaatattatgatagatagctttcctgaatgccttatggaactactgaaatagattcacatcaaatttctacaacttcgtctattgattatcctcgataagaaaattaaatttttacaagccttttccaacattcctgattataatagttcgaattttttagtccttatttagaagcctgtggatattgttattaattttgcgatttaccttcagttttttatcggtttattcgctatcgtaaacccattcggaactttgccgatcttttttagtatgactgctcatcagtatgaagctgatcgcaatcgtactaatttgatcacgtccgtttctgttgggattatcttgctcgtcagcctattttttgggaaagtgattttagatgctttcagtatttccctgaattctttccgtgtcgctggggggattttgattgtgagtattgcgatgacgatgattagcggtaaattgggcgaacataagcagaataaggaagaaaaaaatgctgacctgtctgaatatgaaaatattggggttgtgcctttagcgatgccgattatggcaggtcctggggcaatcggttcaactattgtttggggaacacgttatcatacttgggtagatctggttggatttagcgtggcaatcatcttatttgcaggtatctgttatattttattccgcttctcagcccctttggtgaaacgccttggtaaaactggctcgaatgttgttactcgtattatgggcttaattctaatggcattaggtattgaaattattgttgctggattaagcaatctatttcctggattaacggcaattcattaaaatggcatttattcaacgcattatgcaatttatcaaaaaagggctttttgtgaccgcttgtatcgtggggtttgttgcctgcgatccagaagagaataacggttccgttagacctttgcctaatgcagaaccaaccaatgttttaagccgtgcaatttacgcaaccgagctacaattagaccctcattttgtcagaatatctgctgaagctggggttgttcgagatctatttttaggcttgatggcgtttgatcctaaagggcaaatccaaaatgctgtggcaaaagagtggtttagtgaagatggtaaaaactggctgtttattttagatgaaaatgcgaaatggtcgaatgatcaggcggtgacttccgcagattttgttgcaagctggcaacggttgagtgaccctaaaaatgcctcaccactagcacattatttagtctatatggggattgtgaatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgagctgtcttggttggtgaattacctcctgatgctttgggagttaaggcgttaaatccttacactttacaagttcagttggaaaaagcgaattatcaactgcctaaaatgctggctcattctgcattgttgccaacctatctaggtcagaaaccaaattcaacggatctcgttagtaacggtagttatcgcgttgagcattttgaaaaaaatctgttgcaactgaaagcaagggataaaaatacgcctttccaagtagtgcaatatcatttaattacctcagtacaaaatccaagccgtttcgatattatcgaaaatccgttggaaagctatcatcagcacgaaaaacactttgctcgtttgtgtaattacttttatgaatttaacttcaatgatccgttatttgctcagaagccaatacgtcaagcagtgcgagcaatgatttcgccgatagagatcagcaaaggaagtggcataccctcacatttaatgataccgaaacagctatttagtgaaatgggacattcactttctcataccaatgtagagcagttattaaatgaacaagggatccattcaggcaatccactaaaattaaccttgagttatgataaacaagggcaacatccacaaatcgcagagcgaatgacgagagctttagggcagtctgacctatttagagtacaattacaagcggttagctgggaagagttacttgcaaaacgagagcacaaagatttccaactcattcgttcaggctggtgtgcggattatcctgatcctgtactctttttaacgcaatttcatagccaaagccctgataataaaagtagttatagcaacgctaaagtagatgaactgttgttacaattacaagaacagcctttagatacggctcaaaggcaaagaataatcgctacaatagcacaccaattggaagaagatgtcgcaatcttaccgctttttcaatatcaacgccgaatgagcattgctccaacaattcaaggctttgatgaacaaaatgcaagtgaaactatttatagcaaagatttaactcgacaataccataaggataagtaaatgaaccaacttaccgaacagcaattagctggcgttaaaagcgttttacaaggtttccaacattcaaccttgcaaaaagatttaatcgcattaaatgcgttaaaaaaagccgaattaggcggtgggattttacgtcttgaatttacgctaccttttgcgtggaactgcggatttgaacaattaaagtcaacaacggaagcaaaactgaaagaaatcagtggtgcaagcggtgtgaaatgggtgttaaattaccaaattgcgaccttaaagcgtgccaatagtcaccctgcggtaaatggtgtgaaaaacattattgcggtcacatcgggtaaaggtggcgtaggtaaatctaccacatcggtcaatcttgctttggcacttaaagcacaaggggcaagggtgggtattttagatgcggatatttatggcccttcaattccacatatgttaggcgcagcaaaccaacgtccagtgtcaccagacaataaacatattaccccgattgaagcccacggtttatactctaattctatcggctatttaatggatcctgataacgcaactatttggcgtggaccaatggcaagcagtgcattaagtcagttactccaagaaacgtggtggcctgatttagactatttggtcattgatatgcccccaggtacaggcgatatccaacttaccctttcacaacaaattccagtgacaggggctgtggtggtgactacgccacaagatattgcgttgcttgatgcgatcaaagggatcgcaatgttccaaagagtatcggtgccagtgttaggtattattgaaaatatgagcgtacatatttgtgcaaattgcggacaccacgaaaccattttcggcacaggtggtgcaaataaagtggcagaaaaataccaaacgcaagtgttaggacaaatgccattacatattcgtttacgtgaagatttagataaaggtacgccaacggtggtagcagatcctaaccacgaaatcagccaagcctacctcgatttagccttaaaagtttcgactgagttatattggcaaggtagtgtaatcccatcagaaattatgattcgtgaagtgaagtaatcgtgatatcaaaataggagcttataacaaaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttataagctcctatcatatctaccactgataacctacccccacagagccgcccatttcaccactagtatttgcattaccttgtaatttaaggatcagcttgccgttatctgatgctcttgagtaacccacagccaatgcagattgacctttgaaagtccccgctgatgctgcaaycattgayttaccwgggagataaacctgtggtaaacctgctgcggcgttagaacctgcaatacccgcacgcagagctttattattacggttgatcttattgtgaatatcgcccatmtgcaccttgtgctgagatattaagctatacaactggctaccattaatcgcatcggtactttgctcagagattaaaccaggtgcaacgttttgaatacgacgagtttccattttgccatyactgtctacattacccacgctcaccacgcctacaacttcagttgctttaccgccggcataagcgttatacacrccrcctrttacttggywttctaaagcaccygcycccgcagtggttgcacctgctgccacatagcctgagtttgtwcccaagaakacmgagttgctggttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatgagtaacacaaaactaaagataaaataacaggaatttttcgtttttttgaaaaagatgagttaaatattgatatgattatacttactttccttaaaatactaataagctgtgtttctatactcttctcaagaaaggatcaataaatgacaacacatctctcttttattgagcgttatcgccaattaattcaaattcctaccataagtagcctgaatgaaaaatatgacatatccaataaagcattgattgagttattggcttattggtttagcgatttaggatttaaaacagaaatcattgccattaacggctctcatcaaaaatataacttacttgcaacttatggcgaaggagatggtggcttattactggctgggcacacagatactgtgccttatgatgaggggctctggaatttcaatccttttcagcttacagaaaaagaagggaaattctatggattaggtactgcagatatgaagggcttttttgctttcgtggttgacgtgctcaatcaaattgatttagcaaaacttaaaaagccattacggattttagctactgcggatgaagaaacaacgatgcttggtgcaagaaccttttcacaacatgcacatattcgcccagattgtgcgatcattggagaacctacttctcttaaacctatccgagcacataaaggccatcttgctcaaacagttcaggttattggtaaatctggccattccagtaatcctgccaacggaattaatgctattgaaattatgtatgaggtggtgggtaacttacttcaactcaaaaatagcttaaaacaaaaataccataatgagttattctgtgtttcttatcctaccctcaacttcggaaatattcatggtggtgatgccttaaatcgtatttgtgcttgctgtgagctacaactagaagttcgaccattacctaatttagccatccaagatgcagaggatttagtgcgacaatatcttgcgcctcttattgagacttggggggatcgcattcaagttaaagccttacatgcgggtattcctggctatgaatgcgaacattccgcccagatcgtaaaggtggttgaaaaattattaggagaagaatgtaaagcagttaattactgcactgaagcaccttttattcaacaactctgcccaacactaattttaggccctgggaacattgaacaggctcaccaacctaacgaatatttagatgcaaaatttattgaacccacaagagaattattagcaaaattaattcaccatttttgctagataaaaaaagcccctgtacggggcaactcttttgatctaattctaggaggtatgaattactgttttataaaaggagacaaataaaacaagaccaaaagcaaaaaactaaaggaggaaatcgtttggctcctcctgctggacttgaaccttattctttactacatatagaacaatttgactgtttaagcagcttcatttctcgtatagaaaaatttaaaccatcaattactaaaagccgtccagacaatatttgaccaatattaagtaaaactttaattgtttctaatgcttgcaagctgccaataataccgacaataggagcaatgaccccagcttcaacgcaactaagagtgttttctccaaacaactgacttaagcagtgataacagggatcttgtttttggtaaagaaaaacactcacttgcccttcaaaacgaatagctgagcctgatacaagcggtttctttacattaaaacaaattttattgagtgtattacggattgtcacattgtctgtacaatccaaaactacatcaaattggggaatcaatttagcccattcatcttcttctaaatacgcattaatggtttcgatttgaatatggggattcagttcatgtaaacgctttttagccgattctacttttggcatgccgatagttgcatcagaatgtagtacctgtcgttgtaaattagaaagtgaaaccgtatcaaaatcaactaaggttaaatatccaataccactgcttgctaaatactggctcgctgcacaacctaatccacccaatccaacaattaaggctcggcttgcttttaacttttcttgcccatcaaaatcaatgcttttcaatataatctgacgattatatcgtaatatttctgaattcagcattgtcatttaactttatatcccttctgctccaacattagcttaagctgatctcgattatctccttggatttcaatcacaccatctttaactgaaccaccacagcctgttttgcgtttaagttcagaagctagtgccactaaaccacgatcatctaaatcaacacctgtaattacgcaaacgcccttccctttacgaccgcttgtctggcgttgaatacgcacaatgccatcacctttcgggcgttcagccttcggtttttctggtgtaattcgacctacttctgtggaatacactaaagtcatttgtaaaatttccttctacacgaaccgcttattaggcgatagattgattaattgattttaatactgcaagaggatcggccgcctgggtaataggacggccgatcaccaaatagtctgatcctatttcaatcgcttgttttggggtcatcacacgacgctgatcgccaaaatcactcccttcaggacgaatacctggcgtgacgagtttaaaatctttgccacagtgagttcttaatacctcaacttcttgtggagagcagactacaccatctaaccctgcacgttggcacaaatgggcaagacgaataacttgttccatcggtgacgcattaatcccgatttgtaataaatctaaatcttccatactggttagcacagtcacaccaatcaataatggtgcatctttgccgtaaggctctaaaatttgttttgcggtttccatcattcgtaaaccgccgcaggcgtgtaaatccaccatccacacccccaaatctgccgccgaatgcacggctcttgcaacggtgttaggaatgtcgtgatattttaaatctaaaaagacatcaaatttgcggtcttgtaactgtttcacaaagtgtgtacccaatgtggtaaacatctctttgcccacttttaagcgacaaagggacggatcgacttgatcaacgaaattgagggcttcagcttctgtttcatagtcaagggcgacgataattttgttgtccatttaaattctcctatgttaaatcacttctgtaatactttgcatcggtttaatgctttcccaagttcgacaagatgggcagtgccaagacaagcggtaactttgataaccgcaatgaatacagcgatattgaaatccctgtttaattcgatcaccgaccattttatgtaatagaactaaactctctttgcctctgccctcctccgcttcatttacttgatagtaaataaaacgatggaaagtcattaaacttgggaattgtctaacttgttgataaagccgtgattgtgcggcttctacaccatctttttgttcaataaattcagctaacgccaaatcaacactgctgttgtgtttaatttggttggctttgattaagaacagctcaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagctcaaaattattttgttcatttaacgcaatataacattgcttaattttatgtaaaacttcgctgatgtagttcggttcttgttctaataccgcttcaaaatagcgtaatgccgttcgcatttcttgtttttcaaagaaaaaatcccccaagagtattgaggctcttgcacagtgaggaacgtaagaaagggctttttgtaatgctgttaaaaatgctttttcatcgtccgatctgaccgcttgtgcatattcacaataatagtgagataaagggatcttatccatttcaggctctattctaagccttttttcagcgacattaatcgcttttttccattctcgtgttttgtgataaatcacagcaagctgacttaatgaattgactgcaaactcaggttcatcaagcaaggtaatatagtaattttctgcccgatcataaaaacctgcagccataaaatctttggcaagttgttgttttgctagtaatttttgttcaaaggaatagtgaagactgttttcaatcccttgatgaatccgcaaagctctatcaacctcccctcttgatcggaataaattgcctagagtaatttcggcttcaaattgtgattctgttgaaatctggttctcagactcctgcttttgtagcatagaaaggaaaagatcaaccgccttttcctgctgattagataaaagaaagttcaaacccgtgacatagtcacgggaaaatttgttattaattgcatcttgatccttttttgcactacgttgccccatataccagccatacaaggctgcaataggcaacaaaaggaacaacaattcaagcattattcagcctttggtaaagtaagttcgctaatttgttgagcttggcgttttacacggcgatttaaggcaatattttgtaatttcacttttaaatagaaaaatcccgtgattaaccaacctaaaattaaaccaaatccaaacaaaatggcaacaaggctagataaacgtaattcgctttttgcgatgatgtagttgaatgtaataagctgatcgttatttgccccaatagtcacggcaacaagaatgatagcaagcacaataatgatgcccaaaatatatttcatctgcgtatctccattattacattagtttataaaaaaacgacaccccacatagtgtcgctttcagagaattaggctaaatcaacacgttctttcagttctttgcctgctttgaagtgcggaacatacttagcatctaacttaacgctttcgcctgtttttggattacgtccaacacgaggctgacgataatgtagagaaaaactgccaaagcctcttacttcaatgcgttcaccttgttctaacgaccccataatctgttctaaaatttcttttacactttcatcaacagatttaactgatagagagggatattgagctacgagatttgctattaattccgatttagtcatattttctccttatgcgataggtgaagcggatatgctttcacatatccgcttacgaagagagtaaattactcgccttttgctgctttgaatgcttcagccattgcacttgaaatagcctcttcttgcttattcacttgtgcaagtgctgctgattcttcagcttcgtctttcgcacgaatagaaaggtttacaatgcgagctttacgatcaacacctgtgtatttcgcatcgatttcgtcacctacagagataactgttgtgatgtcttctacacgatcacgggttgcttcagctgcacgaacataaccttctacaccgtctgctaattcaattttaacgcctttagtatcaacttcaaccgctttacctttcacgattgcaccttttttagtgccttcaacgaagtttgtgaatggatcagattctaattgtttgatacctaaagagatacgctctttcactgcatcaacttgtaatacaacagcttctacttcgtcaccttttttgtagttacgaacagcttcttcgccagccatattccaagaaatgtcagataagtgaactaaaccgtcaatgccaccttctaaaccgataaagataccgaaatcagtgattgatttgattttaccttttactttatcgtttttgttgtgagtttcagcgaagtgttcccacgggttaggtttgcattgttttaaacctaatgagatacgacgacgttcttcatcaacttcaagtaccattacttcaaccacatcacctacgtttaccactttagatgggtgaatgtttttgtttgtccagtccatttctgaaacgtgaactaaaccttcaacgccgtctaaaatctcaacgaaacagccgtagtctgttaagttagttactttaccagataatttgctgtttactgggtggttttgtgcaatagctgcccacggatcttgacctaattgttttaagcctaatgatacacgcgttttctctttgtcgaatttaagtactttaacagtaacttcttgacccactgcaacaacttcacttgggtgtttaacacgtttccacgccatatctgtgatgtgtaataagccatcaacaccgcctaaatctacgaatgcaccgtagtcagttaagttcttcacagtacctttcacttcagaaccttcaactaagttcgctaatacttcttcacgatcagcagagcttgttgtttcgattactgcacgacgagatactacaacgttgttacgtttttggtctaatttgattactttaagttctaaagtttgaccttcaagatttaaagaatcacgaactggacgggtatcaactaatgaacctggtaagaatgcacgaacaccgtttaactcaacagtgaagccaccttttactttaccgtttacaaaaccaacaacggttgcttgttcttcgaaggctttctctaacgcagcccaagactcgttacgtttcgctttttcacgagaaagtttggtctcaccgaaaccgtcttctactgcatcaagagcaacatcaacaacatcaccaacttgaacttctaattcaccttgtgcgttgaaaaactcttcagcagggatcgccgattctgattttaaaccagcatctacaagtacatagcctttttgaattgcaactacagtacctttaacaatagaacctaaacgggtttcttgaccttttagtgattcttcaaatagttgagcaaaagattcagtcataattaatcttcttaaataaaataaaacgtccatttagcatccatctaaatggggttagggataacaacttaacaatcctttgttaagcaaacaaaattacaatttttgagcaatataatccaatgcttgttgaataacttcctcaatggataaatgcgttgaatctaaaatcatcgcatctttagctggaacaagaggtgcaacagggcgatttctgtcccgaaaatcacgctcttttatctcggctaaaatctcatcaaagttagcattaaatcccttttcttgcaactgttttacacgtctttttgtgcgttcttctgcacttgcatctaaaaagaacttaatttcagcttctggaaagacgacagtccccatatctcgcccatcggcaattaatcctttaggacttctaaaatctctctgacgttgtaacaaagcctcacgcacttgaggataaaccgcaatttttgacgcattttgacccgcttgtgccgtacgaatttgatcgccaacgttttcaccgtccaaaatgacctgaatttcattattctcaggcacaaatttcacattaagatttcgcccaagctgtgcaagagccgtttcactctcaaaagcaatcccctgttttactgcagccaatgctaaaatacgataaattgcccctgaatctaaaaaatcaaagcctaatttctctgcaagggcgtgacacaaggttccttttcctgcaccacttggcccatcaactgtaattacaatacccatatttatcctttataactctggaaattcaccaataaccacttcaacttctttctgtatgccttgacgagaaattaatacctttaccttactatttggtttcatttctgcaatcaattccatcatttgagctggagtttgggcttctgtatcatttaaacgtaaaatcaaatcaccagctaaaatccctgctttatccgcaggtccaccttcagctactgtagtaattaagatccctttttcaccgactcctagctgtttagccgtatagtacaacgagctattaacaccaaaatagcctcgaataacacgcccgtcacgaataattttttccatcaccttatttgctaaggaaatcggaatcgcaaaattcaatccttctgccaattcatcactattttttcctaaacttaaagtgttaatgccaatcaactcaccagccgtatttaccaaagctccgcctgaattacccttattaatagaaacgtcagtttgaataaagttttgccgacccatttcagataatgcattacgccccgttgcactaataatgccttgtgtaatactctgccctaagtttaacggattgccaattgctaaaaccacatcaccgattttagccatgcgttttgaattttgaggaattgtaggcaagttttctgcttgaattttgagaacagcaagatcagttaaggtgtcagaccctaccaaagtcgcactcgaaatcgtccccgattgcagtgccactaaaatttgatctgcattttggataacgtgtttattcgttaaaatataacccgttgaggtcataatcacgcccgatcctaagttatttacttgtaactcccctgtatcagaatgggtagaatcaaaggcccgattataaacattgactaccgcaggcgacgcaattcttaccgcatcgtgaaagctgataatctctgtttgagtgcttttgtttaagcaaggggcaacataaagaatcaagccagcacaaaaaagcccaaaacctaccgcttgtgctatttttttgacgatcacatttgctccttgttagcgtagggacacactgcgtgtgtccnnnnnnnnnnnnnnnnnnnnnnnnnnnnnnnnnnnnnncagtgtgtccctacattttatataaatttaattacagcgacttcgataattttttcaaataatctttaaattcaccaccaaatttatcgtggttcaaactgtattctacaaaggcttccatatagcctaatttgtcaccacagtcgaaggttttacctgtcatatgaaaggcatccacctcttgttgttcaatcaacatatcaatcgcatcggttaattgaatttcatcacccacaccgaccggtgttttggcaagtaaatcccaaatttctgcagagaagacataacgtcccacaacggcaaaattagacggagcttcttcaatacttggtttttcaatgatgttagcaatcttcgctgtacctgcaggttgtaattctgcaccttggcaatctacaataccatagttactcacattttctttcgccacaggtgcaaccataatttggcttttgcctgtttctttgaaacgttgaatcattgctgctaagttttctgttttttgatctgcagtaaaatctgccaataacacatcaggcaataccactgcaaaaggctcatttcctaccacagctcgaccacataataccgcgtgacctaatcctttcgcttgcccctgacgaacgtgcatcaaggtcacatctttaggtacaatcgaacgcacttcatctaatagctgacgtttcactcgtttttctaacattgtttcgagttcaaacgatgtatcaaagtggttttcgatagcgtttttagatgaatgagtgacaagcacaatttctcttactcctgcagccacacactcgtttacaatatattgaatcaacggtttgtctgcaatggttagcatttcttttgggattgctttggttgcaggaagcatacgagtaccaagacctgcgacaggaataatcactttcatagaaaaatccttaatatatttagataaagtaaaccgcctaccttaagtaagcggtctgttttgcacaaattttttcaaaaaattgaacactgcgtttcaatttatctgtttgtgacatttggttccagactcaaattcacattgcgttagataaaaacctcagtaaatatcaatctaccttattccgagggattttcatctgctaacactttgattctttgataaatttcttcacggtgaaccgaaatttccttaggtgctttcacccctaatttaacttgactaccacgaatacttaggacagtaatttctacatcatcaccgatcaataaactttcgccaatcttacgggttagaataagcataactatctctccttttagatttaatcagggcaagccaaagtcattctaacttgccccttataattagagttttgcttgaatccaattcgtcgcaacattgagggcttgggttatattttctggttggctaccgcctgccattgccatatcagctctaccaccgcctttaccgccaacttcttgagccattaacccaacaagttcgcctgcatttactttgtctgtaagatcttttgttacacctacgatcaaattaactttttcatcagtttgtgttgcaaagacaatcaccgctgaacctagttgatttttcaagtcatcgaccatcgttcttaatgcttttgcatcaacgttttctaaacgttgaacaaccacattaaccccgttgatttgttgagcttgttttgctaattctccaccagcttgagctgcaagtttatctttgagctgttgtagctctttttctactttcttgcttttctcttgtagctgctggattttctcaacaaggcttgccgtatctgcttttaataactcagcactttggttaagaatttgttgttgctgatgtaataagccgattgcattttcgcctgtcaccgcttcaatacggcgaacacctgcggcaaccgcaccttcagataccactttgaataagccaatctcacctgtttgtttaacgtgagtaccaccacaaagttctacagaaaacgctgctgttatatctacaacgcgaactctatctccatatttctcaccgaaaagtgccatcgcacctttttgcttcgctgattcaagatccattacttcagttgtaactacaatgttttcacgaattttcgtattaataatacgctcaatctcttctaagtcagcttttgaaatcgcttcaccttgagaaaagtcaaaacgaagtgaattttctgacacaagagaacctttttgtgcaacgtgatcacctaacacttgacgaagagccgaatgtaataagtgggtcgcactatggtttaaggtaatagcgtgacgacgtgtcgtattcacttctgctttcaccttatcaccaactgataaagtgcctgaagctaattgaccaatatgcccaaagacttgaccatatttttgcgtatcattgacttcaaagttgcaaatatctgaagcaatcacaccgctatcaccaacctgaccgcccgactctccatagaaagcggtacgatccaagacaacgactgcattttcccccgattgaatagcttcaaccgctttaccattgctaaacaacgcaacgacagtcgcttcacattctgtgacctcatagcctttgaactccgttgagccatcaactttaatcacataattgtaatctgtaccaaaattactgcttgcctgcgctcttgcacgttgagcttgcatttcacgctcaaagccagcttcatcaatggtaatactacgttcacggcaaacatctgccgttaaatccagtgggaaaccataagtatcgtaaagtttaaatgccacttcacctgataaaaccttattctccactttggctaacgcatcttctaataacgccaaaccacgctcaagggtacgcgcaaactgatcttcttctgcttttaacgctttctgaatatgcgcttgtttctgcgtcaaaatctcgccagcctgccccattgcttttgcaagggttggcactaattgatagaagaacgctgatttcgcaccaagaatgtttccgtgacgcaccgcacgacgaataatacgacgcaacacataaccacgaccttcatttgacggcatcacaccatcagcgatcaaatacgcacaagaacgaatatgatctgcaattacgcgtaacgatttattgtctaaatctgtcacatttaacaaagaagcaatctctttgattaacgcttggaaaatgtcgatttcgtagtttgaattaacgtgttgcaacaccgcactgatacgctctaaacccatacccgtatctaccgacggcttaggtaatttctttaaagtaccatctgcttgacgattaaactgcataaagaccacgttccatacttcaatgaaacggtcgccatcttcttctgctgagcctggtgggcctccccaaatatggtcaccgtgatcgtagaagatctcagtacaaggaccacaaggacccgtatcgcccatttgccagaagttatctgacgcataaggcgcacctttattatcaccaatacgcacaatacgctcagcaggcacaccaatctctctattccaaatatcataggcttcatcgtctgtttcatagactgtcacccacaatttctcttttggtaacgctaaccactgcggtgatgttaaaaattcccacgcaaatgcaatcgcatcgggtttaaaataatcaccaaaactaaagttacctaacatctcaaaaaaggtatggtgacgagcggtataacctacattctcaaggtcattatgcttaccgccagcacgcacacagcgttgagagctggttgctctgttataactacgcttgtctaatcctaagaacacatctttaaactggttcattcctgcattcgtgaaaagcaaggttggatcattttcaggtacaagcgagctacttggcacaatcgtatgccctttgctttggaaaaattccaaaaaggcttgtctaatctctgaagttgttttcattaaagtcactcaaatggatataaaaaactgtatatctatgtttttactaaagtatattagtaattgacccacctattttacacatttttttcaatacttgtattttttactgcataaattattgacattaagtcaaaaaataaaccgccagagtaactgaatgcgacaactcagctacacaagcggtcttttttcacgttttatttaccaatcaatagcttgagttattcacttgctaaaggaacaacgagcatatctaccgttatactgttcatcacttgacgagtagaagacataaatttgctccaaaaatcctggtgatggccagtgaccaataagtccacttggtacttctctaccgcttcttccagcacttgactaaaatcaccactaccatttaaacgttcagtaacagggtaagtaattttaccagagagttcctctaatgctttgatcgtttcttctgacacagaatcttgaacagacgacatattaatatcaatcaaccccgtgtagagatccgaaaagttcacatcaacgtggataacggataattttgcattacatttttcagcaagactcgcacctttacgcaataatataaggctttcttcagagagatctacggcaactaaaatatgtttatacataatatactccttgttgtttttagtaataactgagccatctcagctttcgagctaatactaccacactccttgtagtgaaaatttgaactagttctcaattttgaaaattctttaaaaaatttgtcaagttatttgcatttcttatctaactttttaatctaaattaaaaagatatcgtgttaaaaatcataactacaaacaatttgatataccaatatttatttttgtgatccccgtcgaaaaacattatttttctacttttctctcttttcatcattggcatactgtaatctctttgattaggtatgttgatgatgtctattgatcgtgtctgtttaatgctctttttcggtttattgccgttgattgttctgcctgcttcgtggcttggctatgtgatggtattttctcttgcccttgcattatggggagtatggcgtgggaaattggggatcttgctgttgggtggtgtgttagcggtgagttacgcccagattatacaacttgcaaaaaaacatcaggaacagaccgctgttaaggtgcaagagcgggtgttagtgaagcaaattttaaaacagcaagaatatcaaactgccgttgtagagcgtgctaatggggactatgtttatgtcaattggcaagcagatgagccattgatactggaagcaagttataacgcggaactggtattgaagcctttgtccgctcgcttaaatgatggcaattttgatcgacaaaaatggtatgtggctcaacatatctcagcaacagctacggtcaaaaaagcagtaaaagtgaacgaacaacaaggcttgcgtgcaatttggcttgatcgtatgcgagaacagaccgccccttttgcaacgcaagggttactgcttgcccttgcttttggtgaacgggcttggttaagtcaaagccattgggagatctttcagcaaacaaccactgctcatttgattgccatttcaggctcgcatattgttctggtttatctgttagccttttgggcggcgaaagctgggcagtggttattattgcgatttcgttatctgaaagcggtggggttgtccttgtattttgcaaggggagtagggtggtgtgtggcgttgggatatagttttttggcaggcttccaaattccaacggtacgggcaatggtggcgatttcattggttttgctggtgcaatatgctcgtcgtcattatacgccttggcagttatggcttcgtggtgtggtgctattagtcgtctttgatccgctgacgttactttccgatagcttttggctctctgttttggctgttgctagcctaattatttggtatcaggtttttccactcaagcggtttgattttgtcaaaaatatgcaaaatcgagtgatgaagttgctgttagagttgtttcatctgcagttaggcatttggctagtgttctcgcctattcaactcagtttttttgatggtacatcacctttcgctttgttagccaatttgatcattgttccactttatagctttattcttatcccattgattttatttagtttattaacagataacctatttcaaacttggtggctttgccatcaacttgcagagtgggggattgattggattgagccattttcccatcattggctctatttaagtgtcgatcaacaatggggattaatatgccttaatctattgattataataggattatatggtgtttttcagcaacgtttttctctctattatgggttagcaacagtggcattgcctttagcattgtggatcggatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggatttcattttgtaaaagatacacttaaaccaccacttgtaaaatgggtgaattttgatgtggggcaagggttggcaatgggattgatttatcaacaccaaggtaaacagaaagccattctctatgatacaggcgttgcgtggcaaggtggcacaatggcggaattggaaatactgccctatttacgccgtgaagggatagtggtcgaagctatttttgttagccacgatgataacgatcacgctgggggcgttttgccattactacaagcctacccaaatgcacggttgatcctttcgggtaaaaatcattatagtaaccaagtcgccgagccttgtataggaggcaatcagtggcagttcagcacaatacaccttgaagcgatttatcctttgcaactgagcgagcgagctaaaaatgaacactcttgtgtattacgagtgtcgatagggaaatatagattgcttcttactggggatagtgggattgcggaagaacgacaatatgcaagccagatcggtaagatcgattttcttcaagtaggacaccacggcagtaaaaccagtaccagccaaactttgttagctcacacacaacccacttgggcgattatttcggctgggcgttggaacccgtggaaaatgccaaatagtcaagttattcaacggcttgagcagtatcaggtgaagtggcttaatactgctcaagtgggaatgatccaagtcgatttttattcagataattacaacatttccaccgcaagaaaccgctttagtccttggtatcaggggataggggcaaatgaataagttgagttttgtagcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttgatgtgccgtagcaactgtttatcgactatctctcaattagataagcacccaaataataacattacttggtttcttatctgaattgaatctatattaattaaactaaaacacctttttaaacggcttcacaatcacttcgccatacacccctgcttccacataaggatcttggcttgcccactgttttgcttcttcaagtgaattgaattttgcaataacggttgagcctgtaaaacctgcttcacctgggttttcatcatcaatcgctgggtttggacctgcggttaaaaggcgatattcggcttgaagttgttttaggcgttcgaggtgtttttcacgcacggctaaacgtttttcaagggtgtttggtatgtcttgagcaaaaattacatagtacataatgtcctccattaaggttcaattaaagctaaggcttggtcaagaactgggttgtcttgtcgtgggataacacgaggtttgccgttgctatccacagcaacaaaggtaaagagtgcttcggtgacacagtggcgatctctcattccttcatacacttttttgatccatacttcgactttgatttgaagtgaggtgcgtccgactttggtgcatttgccgtaacagcaaaccacatcaccgactgatacaggcagtaagaacgacattttatctactgaaacagtcactactctgcctttaactagctcttttgctaaaatcgcaccgcccatatccatttgtgacattatccaaccaccaaaaatatcgccgttggcgttggtgtctgatggcattgcgagggtgcgtaaaattaatgtgccttcaggctggcgtttagtttgtgtttccattattttcctctttttgttctagttgttttaggtgagggtagagatataagccagtgccgataacggcaatgaggcttaatcctgttaaaccgaacaccttgaaatttgcccaaacatcgtcagagaagaactcactgatgatgatgttgatgatcatacagaagatgaaaaagcctgcccaacctaaattgagcttttcccatacgttttgtggcagtttgagttctttgccaagtaacatttggataagaggctttttgaatacgtattggctaacgagtaacgctaccgcaaaaatggcattgacaatggtgactttccatttaaggaatgccaggtcgttaaagtaagcggtaagtaagccgaagaaaacgaccgctattcccataatccattgatttttttcgatttttttataaagtaactgtaaagcgataaattgaaccacggtagcggcaactagcactaatgctgcttcttgtacgccataggttttatagacgacaaaaaagaggatcagtggaataaattcaagtaattgtttcattgtcaatcctattggcgatacacttgatagaaacggaaaccaaatacaacaacaaataagctgataaaggctccgaccacttgtgaaagaataatcccgacatctccgccaattctaccgattaatgaacctagcaagctagggaagaaataacttaagatacaaaataggaaaagcggaaacattctgcctcgacttaatccccaagtaaaacgtagggtttgcataatgctttgtggagcttcaagtaaataggcatagacgacgaggctaagtttgacaaacagatagatacccgttgccatcagcggtaagatcattatggcaagactgccttgttgcccgacggtgccaccaaatgagatcccgattgaaagtggcattaccataaaaatcgtcagtaaaatcaccgggaaaaaggctttgagagttgccccgatattttggctgaaatgttgataagtgccactattgatagatttaatgtttaaaatcaataagatattgataaatacactaatcaaagcagaaataatggttggggcaagttgtgatgtaagtaaagttaacatctcttgatttgatgtatttcctgcctgtatttctactctaggaaagagaaaaatggtggataattgtaataaaattaataatgcggtacccgtaagcgtaaagctcccttgattacggataaaattccaactatcttgtaacaaacttggaaatttaatcggcatttgacttccttaaattaatgtggtgaaaattcaacataatacagtatggtatagcatttgctacatcattctgcgtaactatatggaaagtatagcaactgttgtgataattcgctattgtagattttgtagagatgagtagaatgtaacttgaattatttaacgataaaggcaaattatgtatcacaccttgcaagcaggacagcgttacctcaataccttcccaaatcagaagaaactcggactgtttatgcccgattatcgtttaatccgcttagttaaattttcgtcacattttatgcctgcttttgcttgttttgcgttagtttggcaatactttttccacgatcctgaacaatccattctagccaatgcgaccttaacggcgttgtttgcattgagtatcccatttcaagggttattttggcttgggcgacgggcgaaatcgccgctacccttggggttgttgcaatggtatgaagaacttcgtcaaaagttgatcagtgagcaacataatatcgctgaccaagcgtttccttcttatcaagattttgcgaatttgttgcaattagctgaaaagacgtggggacagagctattttgatgagttgtagttaacatgctgatttttctgctcttcccttctctttctaaaaaaagcactgattttttggctacactcattagccatcacgccacctcgaatttgcagaaaatggttcattttatagtcttcaaaaagatgaaagcgagagcctagcgcccctgttttgtaatccgaggctccaaataccaaccgcccaatacggctatgtaaaatcgctccagcacacattgtacaaggctctagggtcacataaagggttgtatctaataggcgatagttttgtaattgctgtcctgccattcggattgcctgaatttctgcgtgagcggttggatcagagagaataattgcacggttccacccctctccgataatattgcctgttttatcgaccaacactgccccaacgggaatttccccttctgcttcggctttatcagcaagggataaggcgtattgcataaagtaaaaatcctgttcggttaaggttaaatcgcaatgggattgggtgggttggataaacataatttaattaaaatggtagnnncacactgcgtgtgtccataaatcacaattttaggtacaagtagcggacacacgcagtgtgtccctacgcatcagattatcgacgaccacgctcgttaaaacgtttttctttaaatccaccttctttgcgatctttaaagccacgttcttcacggcgaccatctctgccacgacctttaccacgtccgctcttatcttcataagggttagcattagttgcactgcccacaggacctaagaaagacatttgcattggtttgcttaacactcgtgctttctgtgcgaaatgttgcactaaatgtttcggcataccctgtggtaattcaatggttgagtatttatcgtgtaacttgatatgtccgatataacggctgttaatatcgccttcgttggcaatcgctccaacaatgtgacgcacttcaacaccatcttcacgaccaagttcgatacgataaagatccattgccacaccgttattatcacgatgttcacgaccgccaccacgacgttctgcagaacgtggattttcacgtccttttccacgctcagcacgagaagggcgaatttcaggatctggcggaagaataagtttttgtttttcttgcaacaacatcatcattgctgcagctaattcttcgtgatcttggtctgccgtgaatagatcttctaataattcacgataaagctctaaatcgtgatgttctaattgtaatgaaatgcgtgctttaaatttctcacgacgtttttccattaaaatttcgtgatttggtactggcacttcatcaatcggctttttgattaaatgttcaatgtttttcaataaacgacgctcacgcggttctacaaataataatgcacgacctgaacgccctgcacgacctgtacgaccgatacggtgaacataagattctgcgtcaagtggaatgtcgtagtttactaccaagctaatgcgttcaatatcaataccacgtgcggcaacatctgtcgccacaatcacatctaaacgacctgatttaagtttttccaacgcttgttcacgtgcttgttgggtcatatcgccgtttaatgcagcagcacggtagccgttacgctcacagagttctgcaatatcaatggtgccagttttggtacgagtaaagataatcgcagcatcaaactcttctacttctaagaaacgcaataacgcatcatttttacggaagccgttcactaaccagtaactttgtgcaatatctggtgcagaacgttgggttgcctgaattttgacttcttgcggatctttcataaaacgtttggtaatacggcgaattggctctggcattgtggcagagaaaagtgctgtttggtgatcttcaggcagttccgccataaccgtttcgacatcttcgataaagcccatacgcaacatttcgtctgcttcatctaatacaatcgcttttagcatagaaagatctaaggtaccacggcgaatatggtcaagaatacgccctggcgttcccaccaccacttgcacaccattttttaaagcacggatttgaatatcataacgctgaccaccataaatcgtgaccgtgcgaatacctttcatattcttgctgaactgctcacaagcatcagccacttggattgctaattcacgggttggtgccatcaccaacatttgtgggtgacgctgttctggatcgatttgtgctaataaaggtaaagagaatgccgctgttttaccacttcctgtttgtgccatacctaacacatcacgaccatttaaaaggtgtgggatacaggcttgctggatcggtgatggggttacaaaacccatttcatttacagaattaaggatagattgtggtaagcctaaatcggcgaaagttaaagttgtttcagtcataaaattccaaaaataaagaacctgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggatttaattcacgcaaatgaaaaattaaatctaaaaatccccctcaatccccctttttcaaagggggaagtattacacaggagataaaaactacattgttgagcttttaggtaagaaaaataaatagaaagtaaaccaatgctttatataacttgtcatacagtgtaagcggtttgatttgcaaaaaattttgcgaaacctaccgcttaaatcgtcctaatttttcccaacaacaacgggatctgtttgtttcgctctttgatgtaattgagctaattcaaacaacgcaaaacgatactcaacaaagttatatacttgatttgcactagctagacggaaaaggcttttagcctcttcaagctgattcattttgagtgtttgttttgcaagataaaaatatgtttcggttaaaatttctgcataagctaccgtattcggttcagcttgagcaatcatttttaaacgaagttgttcaagagtaaaatcccctagcaagtaagacactaaatgtgtcccccaaaagtcttttgacaaatgcttggcacgttttaacaaatttgcttttgcatcacttgggtttaattctaactcattgaaatataaccataatacacggtaaggatcggacttatctgctttatagaaacgcaataaatcacgttctgcctcagaataacgaccactatagtaaaatgctaaaccacgatttaaacgggtataatcataatttggatcgagttctaacacggcattaaaagcatctatagaactgtcataatcatcttcaagcaataaatataaccctaaataattataggcagctgccattttaggtgcatattcaaccgcttgcgtaaaatcataacgagccaacgaccaaagtcctaaactgtcgtaaataacgcctctttcaaaatgtaattcggcacgttcagcttggcttaatttcgcttcttgcaacacttgcgttaaacgaacaagcattacttcctgttcaaaacgcaactgaggattgagttccgagagaggtaattttgtcggggcaatcatatctgacactctgttcacacagcctgtcaaaaaaatcattaccaaaactaaccagcaaaaacgaaaattaaacaacttaaaacgttgtggcattaataaaaccttaggtatttatcattcttaaaatgaagatcccttcccctatgtgaggaagagatagatgtgattattctgctaattcttgaatttcttcaacaatttctgttgcagttgcatcaccattcagatctttcattgttaagcggatacggccttgacgctcgatttctaccactttcacctgaacgtcttgaccaacagataggtaatccgcaacacgttctacacgagcgtcagtgatttgagaaatatgcactaaaccttctttaccaccaaggatagacacgaatgcaccgaaatctactacacgggttactttacctttgtagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactttacctttgtagattgcattcacttcaacttctgcaacgatctcttcgatacgttccatcacacgtttcgcggcgttgttgtctgttgccgcaattttcactgttccgtcatcatcaatgtcgattgatgtgccagtttcttcggttaatgcacgaattgtcgcaccacctttaccgatcacatctttgattttcttcggatcgatcttcattgtatgaatacgaggtgcgaagtcagaaatttctgaacgtggtgcagggatcgcttgttccattacgcctaaaatgtgcatacgcacacctttcgcttgatttaatgcgatacgcataatttcaggggtgatcccttcaattttgatgtccatttgtaatgcagttacaccttcacgggtacccgctactttaaagtccatatcgcctaagtggtcttcatcacctaaaatgtctgaaagtaccacaaatttctcttcttctttcactaagcccattgcgatacctgcaacagctgctttaattggcacaccagcgtccattaacgcaagagaagcaccacatacagaagccattgatgaagaaccgtttgactcggtaatttcagataccacacgcacaacataagggaattcttctgccgttggcattactgctaacacaccacgtttcgctaaacgaccgtgaccgatttcacgacgtttcggcgaaccgatacgacctgtttcacctactgaatatggagggaagttgtagtggaataagaagcgatctgatttttcgcctgttaattcgtcaatgatttgtgcatcacgctctgtacctaatgtcgcaactgctaacgcctgtgtttcaccacgggtaaacaatgctgaaccgtgagtacgtggtaaaacgccagtgcaaatatctaatgcacgcacggtatccactgtacgaccgtcaatacgcggttcgcctgcgataatacggctacgcacgatttggctttctaatgcggtaataatatctacaatcttgccgcttgaaatggtttcatcttctgcggttaattgagcgatagcatcagctttgattgcgtcaatttgttcataacgtgcttgtttttcagtaatacggtaagcatcgcccagacgagcttctgctaatgctttaactttattgattaaatctgtatttggctctggagcaacccaatcccaacgtggtttgcccgcttctttcacaaattctttgatgttttcaatcaccacttgttgctgttcgtgaccaaacaccactgccgctaacatctgttcttcagttaagatatctgcttcagattcaaccattaataccgctttgtctgtaccagctaccactaaatctaaacggcttaaacgctgttctgatgtagttgggtttaggacgaattggttatcaataaaaccaacacgtgctgcaccgattgggccgttgaaaggcacgccggataaagataatgcagctgaagcaccgatcatcgccactaaatccgggctgatttgtggattgacagaaaccaccgttgcaatcacttgaatttcgttgaagaaaccttcagggaaaagtgggcgaactgggcggtcgattaaacgagcaattaaagtttcaccctcagatggacgaccttcacgtttgaagaaaccacctggaatgcggcctgctgcgtaagtacgctcttgataatctacagttaatgggaagaagtcttggccttcattcacctctttttttgccacaacggtaacaaaaaccgtcgtatcgtccatacttgccattactgctgctgttgcttgacgagcaatagcccctgtttctaaagttacggtatgctgaccgtatttaaattgtttaacgattggagtcatttgaatgttccttatgaatttttggatttgttgttgttttatttcctaaaaattgcgactagcaaaagtaatctcacacatcaaattacttttgatagccgcctcttagaatgcgaagaaataaaacttggctattatacagagattttctgaaaaatcgcctgttatttcggaatttgtgagaaatttataatggtcaagttgatgataaacctaaatctgcttttatttaccttctatatcattatttcctcacttcgttgtctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaagtcagagtgagaggtaagaacagcctaaataactttatcatcgtactgaaacaaggctctcccctctgttttctacctattcatacaacactcttccaccccacaacaacccgcagtaatattaatccgcttgttatgataagggtacaaggtgcaacggtgtccgacactgataatggtgctgtttggcagcacttcccgaatggtacggtaaagaatagactccgttggctcatcaagggcggaagttgtttcatcaaggaaaattaattcaggcttgctgagtaaaattcgcacaaaggcaacccgttgcaattcacctggggaaagggtaagttgccagtcgttatcatcatcaagtgcgtggagatatttatccaaacagcatttttccattgcctgtttaatttgctcgtccgttgcttcaatatgtggataacaaatggcttctcgcaataccgcagaaaattttgcctgtaaatttcggtgttctttggcttcgcccgaataaaaggcgatactttcggcgttatctcgcacacggatcagagagtaacggtaatccccttgtagcttctctttattgaaattcaatgcaatcagtgggcgaccgataatcacagaaagtaaggtagcaacaataataaaaatatagataaagaacaccacacctttcgggatttctacaccgaagatcgccaagatccccgatagcccccacaggataatggtaaattcaatggtggaaacgaccgcattaatcaccccatgcactacgtctaacgtaccgccgataaactctgtcgctttggtgaataaatagatcctgcggaaattgcaccgttagttttactgctttgatcgtggtcacgctgacgttctactgaatcaaacgctagactccaattgtgaagaatcggtcctgtttcagtttcaccttgtaattttaagttcccgcttgttgtacgagaaacaaagtccattccacgaatacccgatactctaaaatcaccattttgcttaattgagttaatttgtccaaatgcacctgagtaacgagatttcatatgtccgaagccacctgaaaccatcatattgtaaggcagatcatactcaaaggttgccattgcggttttatcttcggtcgtctgtccaagccaatctgggttaagattaatttttccatttggcgcaactggcattgcaaattttaagttttgcatatcttggatacgagctctgccgccgtctgttttacgcttactttgcatataatctacgccaactcgtaatttctcaccacgataatctgctccaatcgcaatttctttcgctcgctcatcgtaatcgtgacgagccgtatcaccatcacggtatttgccacttacacgaatgccccactctttattcgcaccaaaacgacgacctaaatcgaacgactcttgtaagcgattgttactaaaccaagcaaaaccgactttgttaatatcttcgtccgttgcacgcttcgtttcgatgttgattgatgcaccagcagaaccttcagggggtccataccaaccgttgctgtcgaagcacctttaattaattgagcagatccaaccgctgttgtcggtgtattgtatgcagaataaagccctgctaaaccatttacactaaattggcgtgcaccaagctgtaagccacgaacataaaccccctgtaaggtagcggattcaccaccgaaattcattactgaagcatctgtttttgcaagcacatctacgatatttctcggctctttgtcagcaaaggctttttcatcataattcactacggtaattgcattgctttacagtaattattacattaaaaaagcgacaaagttaaaaataactttgtcgcagattattacatagtattgttttgtaaatttttatttaaagatcacatcatcttttggatcatattttgacgcatcaattggtgaattttcttcaaagtattttttcaacatttcagcatcaataaagcctgtattcacatagcttgggtgttttttcaggattggataaccatcaccacctgctgcacagtaatcaggcacagacactttgtaagttttattgagatcaagcggtttaccaccgactttcacatcagacacctgttttgcagtacgatcaacaaccatagacacgcctgcaaattgtggatacgcacccatatcgacttcttttagggcaacaacattgaggtaatcaattaactctttacctgttaaatcaacggttgcaatcatattaccgaacggctgaacagtaagcagatttttgtaagtgacctcaccttcattgattgaagcacggatagcgccagagttcataataccaatatccgctttcacacgttccatttgtgattgagcaattaagcgacctaaattcgtttggtggaaacggataactttacgatcaccctcaaggataccacctttcacttcaccgactttcacacccaataatttatcgccttcatcttgatattttttcaagtgctcaaatacagctttatcttcagggatctcttcttgatacagtttatactcgctcttaccgtcagctaacttaattttttgtttaagattgacagggataagctcatatttgactagtttcgtttcaccatttttaaattcaaaatcagcacgacccaagaatttaccccattcacctgcttgaacgatccaagtgccgttttggaaatcaggtttacactcttcacccggtgtatatttgagtttaaatacgcctttctcatcaacacaaacggtatcgtgagtatgtccgccgataatcaagtcaaaagcccctttatccaagccacgagcaagagatacatcgcctggagcattcataccgtgttgttcatcaaagtagtagcccatatgagtaagcgcgatacttacatctggtttttcggttttcttcacttgggcaagggtttcttttgcggttttaattggatcattaaacaccacattttcagtcacatcagggttaccaagttttgccgtatcttctgtagttaaaccgattaccgcaaatttcaagccacctttattaagcgtaacataaggttttacaaggtgtttgtttgtttttttgttgataacgtttgcagaaatgaacgggaatttagcccatttttcttgcatatcaagcacttgcagagggaagtcaaactcgtgattacccaacactgccacatcaaaaccaagcatattcaagccttcaatatctggtcttgcattttgcatatcagactcaggtacgcccgtattgaagtcacctgcgtgaagtaaaacaacctcaccgcctttttcagccacttccttacggattttgtcgatcaaggttttttgagcagcaaatccatattcacccttatcatttttccagaaatgaccgtgggtatcattaacgtgtaatacggtaaagctataggttttatccgcttcatacgccatcgcagtagtagctcccataagagccaaagcaagtggagttttattaaatttcatataagctcctttagttttgacagaaataagtgaaaaactcactggattacaaacataaaatcagtaaccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaagccctgtgataagcattgcaacaaaaacagcggcagagccaatatctttcgcacgacctgataattcatgatattcagacccgatacgatccaccacagactctacagcactattgagtagctcagccactaacacaagcaacaccgaaccgactaatagaattttttcgattgccccatcgcctaaatataaaccgacaggaatgagaaaaaaagaaagccacacttcttgacgaaatgcggcttcgtgaatatatgcacttttcagacctttcattgaatagcctgtagcacggacaatgcgttgaaaatttgctttgttttcaggtttcattaactttataaatagaatacgactaattagtcttattctaacgcaattacctgtttatggaaacaattcatttaatagtgaatatgtatttatttttgcaatggaaatctaaccagtgcttgatattacatattaattgtattaaaagcagaaattcctataatttttccacattatctattttgctaacccatctaaccgcttcattccaatcttccctccaatctttcaataattcaacccaagaaacgagattattttcccactcatttccattatcactttgagctaattgcgcaatttgttgtaaatgaactaagcccacagatgccaatgcccccttgattttatgcgcttcatccgcaacacatttacgtttctgtatatcaccagtctcttgccaatcctgtaaataatcatttaaattctctaaataattaggcattaagttggcaaagagatctaatgttgataacacattctttttacccattacctcaaccaactcttgaagcattttaggatcaaaagacattttacttatcggttctgacaagactacatcgtccgaggattcctctaaaaacccttcatcaaaatatctatttaagcattcagataaagcctctaatgatagtggtttacgtaaaacatcatccattccttgttgctgatattcagctttggtttgcataatatttgctgtcaaagcaattaataaaggcagataatcaacatctccgtcctcatacctctgacgtaatttttgtgctatttctactcccgtagtatcaggcaactgaatatctaataaaattaagtcataactatttttatcaaataactcaaatgcttctgctcctgtcattgcaacatcaacattacacccaaacttatccaacatagcttttgcgacgacaatattgacttcaatatcctctaccagtaatacttttagtgcatgtgtatttattgctacttctttataatgatttgcttcatcagcttgaatgataagagtaaaaacagaaccttgatttaattcactctcaacagttaaatctccgcccattaagcgagctatacgtttcgatattgctaaaccaataccacttccctgagctttcttaccctgggaattttctgattgataaaacattgcaaaaattttacgctgctcacttttctttatgccaatccctgaatctttcaaaataaaagcataatgatcatgatctcgacgttccacttttagtgaaatctctcccccagaaggggtaaatttgacggcattattcactagattccataaaatttgactaagtctagcattatctacacagacaaaatcaggtaaattatcatcgtactgaattgtaaatttaatttttttctgctctgccattaaattagcaaaatggctgatgttactgattaattgtgagaattctacttcactacgaaataactcaatgcggcgactatcaattttttccaaatcaataatatcactgaaaatatgccctaacgatacagcactaatattaattgtttttaaatactctctttgttgtgcagataattcaccttctaataaaatgcggcttaacccaatgataccatttagaggtgttcgtaactcatgactgattgtggccatcaacgttgacttatctcggctatttttttcaatcatttcttgatatcttttacgctcagtaatatctcttccaaaccccataatacagtgacattcatttactctatcatagtaaggcaccttacgaatttcaaagcaggaaagtttattgttagaatggcgaatccactgttcgtaagtaactccagtattactaattagagtatctctatctgtatctagaattaatttagcggtttctttaggataaatatcttttggagtaagatgaagtaactctttttctgaacgtcccgttaaaacttccattgccctattacatccgagaaattccccatgttgattacgataaaaaacaagatctggagaagcatcgaagaaagaacgtaaaaattcagcctgttgttctaactctacatttaaacgagcatcttgttcacgtaacaaggaaagatcattcaacgattgctccaaacgaatacgagaacgttcaagtttttctaaaattagattaaaaaaataaatcacgaaaggagccgatgttagaccaaaaataatagaacgaaaaatatcgctagtatttatgctcccagtaaatatccagctcaataggctttgtgtaaaaattgcaaacaccgctaaaataatcaaacccaataatgcggatttccctttacctaaacgtaatacccaattgacataacgctgggcatattgctttggatttttcattattacctcatcaatattcgccactactcataagaaccaatcttagttgattgattcttttaattcatcaaagaggctaaaaaatttaattgatattaaacgcttcaatataaggaagaattccttttttaagcatcttaggcacggtatgttcataatttccattaaatctaacttcaaaattaataccaaaacgattatcatagtagaaatcatttattgtatcgcttttccccatcggagttgaaatcaaatgtctagaagtataaaaatttgcactccaacaacaagtgctataatttaaacccaattgactctcaaccggtttttttaaagcaatatcttgatagtggctcattactattgataaattattgctcaatgaccaagctataatacctccaacttgcttaatatcctgcccatagcgattatcacttaaattttgatctatatagtttttgcttgcataacgataattaagctgaatcacgttattatttttaggcttaaattgtaatgaaacatttgctaacgatgtttcgtttagacgtgtatcatattgataacttccatgccaattccagtttgaatgaaatttccagttagattctaatgaccaagaagatgagtgttttgtatcgctatttaacgactcactatcaactcttgaaggagataaatattgaatctgtcctgcactaaagttaaatacttcttttcctgttttgtcgctaaaaaatcgtgtagtaccgcctaacgtaacctgattagcagaggcaatgcggtccaacccactataactacgctcattaaataaagagtaataatcctgctgcaataaaacggagtcataacctaaacctaaatatttaggatttctaactccaatatttccttgatttttatatggacgatataaatattgtattgttggctcaaaaacttgtgaaaacccattaaacaaaggtctttccttttccaagacagttttaaaatccaacttaaattgaggtaatacccggagtatatgtgactctatcggtattgcttgtgcttgccccagtttctgtaaataataggtggtatatagcttagtttctaaagctaaacttcctaactggttaacaaaaggaacatttaaactaggttctaaatgaaaacgccacgctgatggcatgagtttattttgattaacaaaatgcgccatctgcccaaacatcttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctgcccaaacatcttgaaatcaacatcagaaactaaattatttttatagtaattaagctcaatctttggtaacacatgataggtagtgctatcattttttacgtaaaatgactgaaatttttttcctgaaatagaaaaattataatctgaatgatagtaccctaatttaaactgctgtaccgcataaccatcagtactattcccgtacatagaattaaaatcagaaaagtaccgactatcactaactcttgtataatcaacagctaatctccaattattaaaaaaactcatatcatgttgccaaaatagcatataacgagatttactatgatttgcccaattttcaagtcgatccttacctaaatattcaccggctattttaccttctcctaaataagttaaataacgcagttcaggtgcaatctgccaaccacgttttgaatagtatgttggtacaaatgtcatatccatgttagaagcaatattccaatatattggctgtgcatatatataaccatctcgtcttgaatgaccaacactcggagccaataaaccagaacgacgacgatcccctattggaaattgcaaataaggagaatagaaaataggtatacccaatactttaaaacgcgcatgccataattcagcatattcctcttcaacatgctgaaccatttcattagcttcaatagcccaggagttatcatgaggtaaacaagctgtaaaagttgcatttttcattcgacgggcttgttcagctatcatgacttcatcagcaatacctcttccttgtcgaccaactaaatggtaatcgaccccgcctaactgagcatcatagttgttcaaattaatctttgcattattacctatcgcattaatgaaattatcccgataatcgaatttaccgattaaataagcaaaacgcatctgttcgttattctgttctaccttagctttttctgcaataagagaacgattaccttgcttaacactaacttcaccaaaatatgttgcctcagaaggataattcatttccatacgatctgactcaatatacacaggtagaagagtctgatcaccttgtataatatccccctgaaaagtaggaattccttgtaaacattgcattctcaaatctgctattacatattgactacagcaagctgcaacaatagcaatagaaagtaaactataacgatatggtttcataatttgattctactcacatttgtaaacaaataagcctatgtaaccgccttatttgcaaacattatcattaaatgattcttgaaaattgttgtcttttagcttgctgtcttgaataaatatcaaagcacatacagatatttctgatcaataaacgccctcgaggcgaaacaacaatccccttttcaccaatctctagcaaaccatcttttgctaacggtgctaatagtgataaatcctctgcaaagtactgattaaaatcaatctgataatcttgctcaaagcggtcatattctagcttaaaattacaaattagggctttgatcacatcacggcgtaaacagtcatctttagtcatactcaaacctttgtgtaatgcaataccacgcatttccacctcggtataatactgtttcagctctttatggttttgagcgtagctatcccccagtaaactaattgccgatacccctaagcctaacaaatccgcatcttcttgggtagtatagccttggaaattacggtgtaattccccttttgcctgagcactcgccagttcatcattaggctttgcaaagtgatccataccgataaatttataacctgcgttacctaaagtttcaatcgttttctgtaaaatttcgagcttcgtttcaggggctggcaacatttcatctttaattttgatttgtgctgcaaaacgacttggtaaatgggcatagttaaacacgctcattcgatcaggatttaactgaatcacacgttctaaggtaaacataaaactttctaccgtttgtttcggtaaaccgtagatcaaatcaatattcgttgaggtaaaacctagctctcttgcacgtttcattaatgcaaaaataaattcctcgtcttgctcacgattaaccagcttctgaacctctttattgaaatcttggatccccatactaatacggttaaacccaatttcacgcaaatgctcgagcatttctaactcaatctctcgcggatccatttcaatactgatctctgcattatcgctcacgttaaaatgtttgcgtaacatcgccatcaaacgtaacgattgatcttcatcaagataggttggcgtaccaccgccccagtgaatttgagttactgttctatccttaaataaatccgcacggtatttaatctctttttctaaataatccagataaatatcgactttatgctggtggcgtgtaatgattttattacaagcacagaaataacagagcttatggcaaaatggaatatgcacataaagtgaaagtggcttattaggataacgtgcagcagcagctttaaaatcatcatcattgtaagactcgttaaactctaacgctgttgggtaagaggtatagcgaggtcctgattgattatatttttggataagattaatatcccaaatgatgtctgtcattgttattttaactcttgtttaaattgctctatgtcgcttaataattgatgaagttcctgcttaatctgctcagataactcggcctctttcgattcacgctctaggtcaagtctcattcgttcattacgttttaattccttacgagcctctaaaattggcattgattcaaccacttgatacagtgcccacatcgctggatattgacttaattttttgcccaatacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagtaatggtttcaatcgtaataccccttcagaaaaaccgcattgctctgccagcattgctcgcccaataacatcaatgctctctataatcgaacgatagcgattaagttgtgcctcttttaactgttttttctgtttttttaatttaagccataaggaaattgcgtaacctgccatcgacagcacaatcaaaatagccaaaataattagaaaaaatcgcattatcatttttaacggaatttattaatgtccatcgtttcaaattgacgtagcaaatcttctgcttcgtcttcttcatcttgaatccccaattcagtcatcaattcgtgaacacggtctaaacattcatcaacaaatttctgatcctgggcagataatgttttacctgcttccaaatcatctaatagctgatttaaacattcattattttctaactgttctaactcttgttcagggcttaaacgaggtttttcaacttcaattggcacaggtttaataacacgacctttttctggttgattaacaaattccaccatcaaaggcacttttttacggctaccaatacgcggatcttttacctctttctcaactttttgtttttgctcattcccttcattcgttcgagagcctgacggtaaacctttatgcttacgttttttcttttcctcacgcgcagctaaatctagttcataacgcgttggtttacgacttttagaaggttttgctttaggttgtaagggtttatctgcctttcttgcaggcataatgtcggtaagacgacgacttttcttttgacgactcataatgtaattagtgaataaaaataaattcagattgtatcactaactggaaaaaatagaaaagggtgatataaatcaatccatgcctatactcaggaatttaattattttttatcatcttcatctgtgaaggttccaaggttgtcgcctctttccctaacaataaactcaccgccatcgcacttcgtgcaaaaaattcacgaatccgcactttatagtgagcatctggatattttgccgtaaaacagaccgcttcaatttggtgaaattttgcaatgaataaggctcgttcacaatgaaactgctgagaaatgatgataaagggttgtaattgaaacactttatccgcccgaataatcgaatctaacgtattataaccagcataatcctgtctaattcgctgccacggaatccccatttggcgtaaatcatgggtcatcattttgggctcattatagtaagcggtcttattatcaccgctaactaataaataattgaccttgctatgctcaaataccgctttagctgcatctaaacgatatttgtagtaaagattaggcgagcctgacggataatattttgcggttcccagaaccaacgcatattcccgttggggtaattgtcgtacatcaatataaatttgatctcgcacccaatagcctgttgcaaaatcaatagcaaacatcagcaaaaaaagaggaaagcacaatcccaatatgcctttcatcagccaaatgcttacgcgagctacccaacgtctccccgttgtttttgctgtcgattgctctgtttgagattgttctgccatcatctacttctgctgagattgtttcgcttcggcgtgtgtaatatacatcgtcgccccaataataattgctgcccctaaccatagcttacctggcggcacccagttaaagacaagccaacctgccaaaacgttcaatggcaacttaataaaatcaaaaggttgaatataagaagcatcggccaaactataggctttagcgacagcaagctgtgccaatgcggtaaaaaatcccaataaaattaagaaaccaaaatcactaaatgatggcaaactaaatccttcagggcttaaattcgtcaatgcgatcaacaagttaaatggggtaattaaaataaatagataggctaccattgtggttggcgaatcttcgctagagagctttttcaccatcaacgaataacacgcccagaaaaatgcggcagcaacaggcaataacaccacccactcaaaattttctgaccaaggttctaaaataatcatcgcccccacaaatcccaagaaggtcgcaatccagcgttttgtatccaccttctctttcaaaaacagccctgagccaatagtcacaaatagaggcgatgtcatcaacaacgcaatcccctgccaaatgggaatgggataagctaaagccattgtccaacactgaataccgattgccgacaaaaacacccgaaaacagtgcataccaaaatgcttcgtcctcaacgactgaaaaaagcccatatttgccatacttggcattaaaaagacaaaagcaacaaggtattgcaccagagcaataacactggcatcaattgttgaaacggaagttaatttaggaataagcgtattgacacaagcaaataaaaagcctgcggtaataattgcaatagcgcctttgacggggtggtgatgtgacataactacttaaaaatgaaaacaaaataagccactagcatagccgagctataataaattgcaagtttgattttcaggttacacattaccaatcgatatataacatagtaaataacgtaataatctcaacctaaagcgttatcgtctaacttcctgagcaatttgataatcgtcaaaacttcatcaacggaaatctctatattccctacgaacgacttaatcgggtcaattttctattttgtgaggaaattatatgaaacatcaatcagacagcagccatttttcggcagaacgacgttcgtttctcaaaggtggtgctgcgttaagtggggcggcacttgcagcaagtgctgttcaaattccaattgcaaaagctaatccaaaaccaaccgcttctacagcgaatgaaaaacttgtttggagtgcttgtaccgtaaactgccacagccgttgcccgttgcgtatgcacgttcaagatggagtgattaaatatgtagaaactgataatcttggtttagacaattacggcgatttccaccaagtgcgtgcttaccgcttgttagctttgtttcatctattgaacacaaactaccaacagcgtggcaaccgttagggcgtgtagtggttgctatttcaggtttaatttttatcggggcaatggcaaaactctacctaatcccaactgtgccaacgtggaatagcgtctatacgccagtatcgtttttcttaacggttatattagctggttctgctttggcagtcggcttattacaagcggtacgttgcggtgagtatttacaaaaaaccttggttggtattgcaatcgttggggcgattgccactgcaattagcacctacttgaactatcaatatctcttaggggtaaaaacggcgatattcactgcattagatctcgtacctgattatctcactatcacctttatccactttggattgattattgtcggtattgtcttattgctagtagcactgaaaaaacgcactacactcatcagcttcagcggatttgcgttaatcctgatcggcgaattactcggtagaaccttgttttacggattacatatgacggtaggattgaaagcgttagggggctaacttatatagcatttctttcacttcccttccctcttacgagggaaggtggaatagcataacctgataacatgtcaaagatacttgaattaaacaagaaaaatttgacagaagcaaaggcaaagtgagatggtggtaagaacgctccaaattactttgtcatcgtcccgaccaaaaaagtagattacttcttccaccccttcaacgcatctgcaaaagcattgttgccaaaactttgacgttcagacttttgcgagcggtcggatttgccaaactctttgcgtttctcaccgcttgtatcacgtttatccgttggcttatcgtccaaacgcatcgttaaggcaatacgtttacgagccacatccacttctaacaccttcactttaaccacatcacctgttttcaccacttggtgcggatcttcaacaaaactgttcgacaacattgaaatatgcactaaaccgtcttgatgaacgccaatatccacaaacgccccgaagttagttacgttagtgacagtgccttctaaaatcataccgactttcaaatcgctgatttcttctacgccgtccataaagatagccgttttgaactcaccacgaggatcacgacctggcttttcaagctctttgaaaatatcgtttaccgttggtaaaccaaactgttcatcaacaaaatctttggcattcaaactatgaattttcgttgaattacccatcaactcacctaacgtagaagcggttgcttgcaagattttttccactacaggataggcttctgggtgaacacttgaagcatcaagcgggttctttccgcctaaaattcgcataaaaccagcacactgctcaaaggcttttggacctaagcgagcgacttttttcagatcagaacgggaattaaaacgcccgttttcatcacggtaagccacaatattttgagctaaggttttcgtcatacctgccacacgcgcaagcaatggtgcagaagcggtatttaagtccacgcccaccgcatttacgcaatcttcgaccaccgcatccagtttacgtgccagttgcgactgattaacatcgtgctgatactgccctacaccaatcgctttaggttcaattttcaccaattccgccaacggatcttgcaaacggcgagcaatcgacaccgcaccacgcaaggatacatcaagctcagggaactctgttgcggccaattctgaagccgaataaacagatgctccagcttcactcaccaccacagtttgcggtttattctctttgatctctttaatcacttctttggcaaagcgttccgtttcacgagaagccgtgccgttaccaatcgcaattaaatccacattatgctgtttaatcagcttataaatggtcaccattgcaacgtccatctgtcccgtatgaggataaatcgtggtgctatccaataatttacccgtattatcgaccacagccactttcactccagtacgcaaacctgggtctaatcccattgtatttcttgcccctgcaggtgcagccattaataatgcggataaattacgcgcaaatacatcaattgcttcttcttccgctttttctcgcaatgcccccattaattccgtttcaaggtgtaacaacgctttgattttccacgtccatgcaatcacctgtgaacgccaactgtctgctggttgctgacgaagttgtacgcctaaatgttcacgaataatctcttcacaataacttgaacggctaccttcttccgcatcaggatcggcattcaaattaagcgacaaaataccttcattccgcccacggaacatcgctaaggcacgatgtgacggaacatttttcaacggctcactgtgagcaaaatagtcacggaatttctcgccttcttcttccttaccttcaatcaccttggcttcaagggtggcattagcggtcagatattgacgtaattttgcaagcagatctgcatcttcggaaaaacgttccatcaaaatatatcttgccccatcaagtgcagatttcacatctgccacacctttttctgcgtccacataggcttcggcgactgtttcaggcacttggctaggatcgttccaaagactgtccgccaacgactcaagccctgcttcaatcgcaatttgcccacgagtacggcgttttggtttatacggcaaatagagatcttcaagctccgttttactctgcgtttgttcaattttctcacgcagttcatcggtgagcttgccttgctcttcaatggatttcaaaatagtttgacggcggtcgtttagctcacgcaaatagagtaaacgagtttcaaaatgacgaagttgagtatcgtccaatccgcctgtgacttctttacgataacgagcgataaacggaatggtatttccttcatcaagtaaagtcatcgctgcaaaaatttgttcagatcgcaccgctaactctgcggcaataatttggctgatttggtggttgagttctgtcattgggtatcctgtaaaaacacattaaatttacaaggcatattttagcaggggaatgggaaaatttctgagaaaaaagaggttacatattagtataaaacctctcattccgagaggttttattgcgctctaattatcttttcttcgcttttggatttggaagatctgtgatagagccttcaaatacctctgctgcaagacctacagactcgtgtagagttgggtgagcgtggatagttaatgcaatatcttctgcatcacagcccatttcaatcgctaaaccgatttcacctaacaattcaccgccgttagtacccacaattgcaccaccaagtaaacgatgtgtatctttatcgaagattaattttgtcataccgtctgcacattcagacgcaatcgcacgacctgaagcagcccaagggaacttcgccacttcgtagtttaagccttcttgtttacactctttctcagttttacctacccaagctacttctggctcagtataagcaatagatgggatcacttttggatcgaagtaatgtttttgtcctgcaattacttctgcagcaacgtgaccttcgtgaacacctttgtgtgctaacattggctgacccacgatgtcaccgatagcgaagatgtgtggcacgttagttcgcatttgtttatctaccgcgataaagccacgatcatcaacattcacacctgctttacctgcatctaatagtttgccgtttggtacacgaccgatagctactaatactgcatcatagcgtttagtatcgttgcacgctttgccttccattgaaacatagataccgtcgtcttttgcttcaactgcagtcactttagtttcaagcattaatttgaatttcttctcaatgcgtttggtgaaaattgctacaacgtctttatccgctgctggaataacttggtcgaacatttcaaccacttccacttctgaacctaaggcttgatataccgtacccatttctaaaccgatgataccaccacccataatgagtaattttttcggaatttcttttaatttaagtgcgtctgttgagtcccaaatacgcggatcgtggtgtgggataaatggtaattgaattgggcgagaacctgctgcaataatcgcattgtcgaatttaatggttgttgggtgtccatcacggtcacgagcaactagcgtatgtggatcagcaaaggttgcctgaccttcaacaacagtcactttacgcgcttttgccatacctgctaaaccgccagtcagttttgcaactaccgcttctttacctgcacgcactgtgtctaaatcaatggttggttcgccaaatgtaataccattatgctctgcgcgttttgcttcttcaatgatttttgcaacgtgtaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataatgctttagacggaatacaacctacgtttaagcacacaccaccaagggttgaataacgttcaactaagactgtttctaaacctaaatcggcacaacggaaagccgcagaataacctgctggacctgcaccgagtaccactacttgtgttttaatttcttggctcataaaatttttcctcttatgtagggacacactgcgtgtgtccgcggacgcaagcattgcgtccctacaataagcggtcttttttgcagaaaattttgcaaatctgaccgcttatatcaattacattactaaacgacgaatgtccgcaagtacaccgttaatgtagcttaagaaacgagcaccatccgcaccgtcaattacacggtggtcgaaagataatgataacggaagcattaagcgtggctcaaactctttaccgttccattgtggcatcatttctgatttcgatacgcctaaaattgcaacttcaggggcattcactattggtgtgaagtgggttgtaccgataccgcctaagcttgaaatggtgaaacaaccgccttgcatatctgcggcagttaatttaccttcacgcgctttcttagacacttccattaattcacgagaaagctcaatgatgccttttttgtgaacatttttgaatactggaacaactaagccgtttggtgtatctaccgctacgccgatgttaatatatttcttaagggtaagtttttgaccgtcttcagaaattgagctgttgaaacgtgggtacgcttctaacgctttcgctaccgctttcataatgaacaccactggcgtgattttcacatctaatttttgtttttcagccagtttgttttgttctttacggaaattctctaaatctgtgatgtccgtacgatcaaagtgtgtaacgtgtggaatcatcacccagttacgatgtaagttcgcacctgagatcttattgatacggcttaattcaacttcttcaatttcaccaaatttgctgaagtccactttcggccacggtaataagcctaaacctgcaccgttcgctacgccattgcctgcygcyggtgctttgcctgctttcacatcttcaaagacttgaaccgcagttttcacgtaagcttgaatatcttctttaacgatacgacctttacgacctgtacctttaacacgatctaggtttacgccaaactcacgtgctaagcgacgaatcactggggttgcgtgggcataaactgcacttgcaaccacttgttcttggcttaaaccagacacattacctgattgtgctggctctgctgcaaccagtgcaggtgttgccgctgcttgtggagctggagcagatgccgccgctggcgctgcacctgcgacttcaaatttcataattaatgagccagttgaaactttatcgccgactttcactaaaatttctttcaccacacctgcgattggtgctggcacttccatagaggctttatcgccttctacgttgatgatagattgatcaacggcaacagtatcacccactttcaccataatttcagtcacgttgacttcatcgccaccgatatctggtacattgacatcaacaactgcactcgctgtcggtgctgccgctggagctggtgcaacttctgcgaccgcttgtggtgctggtgctgaacctgccgcttctaaaactaacattggtgaacctgtggtcactttatcgcccactttcactaaaacttcttttaccacacctgcttctggtgctggtacttccatagaggctttgtcaccttctacattgataatagattggtcagcagcaatagtatcgcccactttgaccatcacttcggttacggtaacttcatcaccaccgatatctggaatttgaatttgttttgacatttttatttttccttaatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggggggattttatgcgtataacggattaatacgatctacatttaagccaaattttgcaatggcatcagcaaccactttggtttctactgtgccttctttcgctaattgacttaacgcagcaacaacaacataacgtgcatctacttcaaagtgttcacgtaagtttgcacggctgtctgaacgaccgaaaccgtctgtacctaaaacgtggtagtgtttgcttggcacatacgcacggatttgctctgcgtaaagtttcatatagtcagttgacgcaactgttggtaaatccgctaacacttgtgaaacataaggtacgcgtggggtttctgttgggtgtaataagttccaacgagcagcatccgcaccgtcacgacctaattcgttgaatgaaggtgctgagaagacatctgcagtgacaccatattcattagcaaggatttgtgccgcttcacgtacatggcgcatgattgcacctgaacctaacaattgaacgtggcctttgcctttaccttctactgtttcaaacttatataaacctttacggataccttcttccgcacctgcaggcattgctggttgttcggtaatttcatttaatgtcgtgaggtaatagaacacatcttcttgtttttcaccgtacatacggttgataccgtcttgaacgataacagccacttcaaaggcaaatgctggatcgtaagtgatacagttcgggataacgcctgcttggatatggctatgaccatcttcgtgttgtaaaccttcaccgtttaaagttgtacggcctgatgtaccaccgatcataaagccacgtgctaattggtcacccgctaaccacatcatatcgccaacacgttggaagccgaacattgagtagtagatgaagaatgggatcatcggttggttgtttacagagtatgaagttgctgctgcaacccaagacgccgttgcacctaactcgttgataccttcttgtaacacttggccgtctgttgcttcacggtagtaagccactaaatcacggtctgacggcacatagttttgaccatgtgggttataaataccgatttgacggaataaaccttccataccaaaagtacgggcttcgtccgcaatgattggcacgatagtttgaccgatatttttatcttttaataagatatttaatacacgagagaatgccattgtagttgaaatgccacgtggttgtacatctaataatgcttggaattctgataatgcaggaactttgtactctacggtaaatttcggtttacgtgctggtaaataaccatttaactctttacgacgaccgtgtaagtagttgtactcttctgaaccttctgggaaagttacatattctaagttttctacttgttcgtccgttaatggcaaatggaagtagtcacggaagccttttaagctatttaatgacatttttttcgattggtgagccgtatttttactttctgcttcagggattttatagccttttacttggtgagctaagataaccactggtttatttgaacgtttcgcacgctcaaatgcggcatacattttctctgaatcgtgcgcaccacgacgtaagtgccaaatttcatcatcagtcatatcagcaactaatgcagcagtttctggataacgaccgaagaagtgttcacgtacataagcaccatcttttgatttgaaggttaagtagtcaccatcaactacttccatcattaattgtgctaacttacctgacgtatctttagcgaataatttatcccagttgctaccccataagactttgatgacttcccagccggtacctgtaaataaaccttctaattcttgaacgattttaccgttaccatttactggaccgtctaaacgttgaaggttacagctaataacgaaaatcaagttatctaatttttcacgacctgcaacggttaatgcacctttagattcgatttcatccatttcaccgtcacctaagaaggcataaacggtttgacctgatgtatctttaataccacgattttgtaaatattttaagaaacgtgcttgataaatcgcattaaccggacctaaacccatagatacggtagagaattgccagtattcaggcattaatttcgggtgtgggtatgaagataaaccatcagcaaaagcttcttgacggaaattatctaattgctctgcggttaaacgaccttctaagaaagaacgtgcatagatacctggtgcggcatgaccttgagaataaactaagtcaccgccgtctttatctgttgctgctttgaagaagtggttaaagcacacttcatacatggttgcagcagattggaaggttgaaatgtgaccgccgagatccaaatctttcttctgactacgcaacaccatcgcaatcgcattccagcgaactgctgaacgaatacgacgctcaatttcttgatttcctggataaacaggctgttcagacactggaatggtgtttacataatcagttgttacgcctgatggaagccctacaccctgagtgcgagcatgttgcattacttgttgaataataaattgagcacgctcagtgccctcttctttaactaaagagtttactgagtctaaccattcttgcgtttcgaatggatctacgtcatgtgctaacatttctgacatagtcttttccttttttttctctgatgaataaaacattgcaaaattgttacaattttgccaaccgttgaaactttaaccaaaagtccgttatttatttttgttttagatcaataaaacacggcaaatagccctactgatattcgtagagctacttttaggaaagcgtctatcgccttgattttcaacgacttttttttgatttatcaaaaattgttgaaaatttatagacaaatttgacctcaagatagcaaaaaccacttattttgtctatttttcaaagcctaaaatgttagcttcatcacagattatttctttaggcaaacgtttgctttttgtgatacacttctcaccgcttgtattacactcaatccaaagggacaaaatgacaaccaacatcgaaatcgccattgtaatgggttcaaaaagcgattgggcaactatgtccgaagcaacccaaattctcgatcaatttaacattccttatcacgttgaagtcgtttcagctcatcgtacgcccgataaactgtttgaatttgccgaaaccgcagaacaaaaaggttacaaagtgattattgcaggagctggcggggcggctcatctacctggtatgattgcagcgaaaaccattgttcctgtcttgggtgtacctgtaaaaagctcaatgctcagtggcgtggatagtctttactctatcgttcaaatgccaaaaggcattcctgtcggcactcttgctattggtccagctggggctgcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcaggattattagcggtacaaattttaggtgcatttaaccctgaaattgcactaaaattacgatctttccgcaatgaacaaacacaatctgtgttagacaatccagacccacgaatttaaatgagtaaaaaattattaattctccacacaggtggaactatttcaatgagcgaaggcgaagacggcaaagtatcaccttcagctcaaaacccacttttaacggcgttagctaaactcaatcaccctgctcaactttatcaagaagcgattttacacgttccttcgccccatattaccttggcacattggcagttgctaaaagatcggatcgaacaggcagtgttagccgaaggttatgatggcatcgtgattacacacggcacagacaccttagaagaaacagcctatttccttgatttagccttgaaagtgaatgttcccgttgccattacaggggcaatgcgttctagcaatgaattaggctctgacggtttaattaacctacaaagtgctattttggtggcattaagtgatgaaagccaaaacaaaggtgttttggtggtgatgaatgatgaaattcataatgccaaatttgtgaccaaaactcataccactaacgtagcaaccttccaaacgcccacatttgggccttgtggtttggttaccaaaaaccgtgcaatttattttcaacatctgaccgcttacgaacgctttccgattgatcgtttggaaaaatcaaacattcaactggtcaaagcctatgtcggtatggatagcttcttactagaacaactggctcaaagccgttgtgacggcgtagtggttgaagctttaggggcaggaaacctaccgccatcttgtctagcagggatttccgccctattaaatgcaaatatcccagtggtattggtgtcccgtgcctttaacggtattacgcaagatgtgtatgattatcttggtggcggtaagcaactgaaacaacaaggggtcattttcacccaaggattaagcggacagaaagctcgcattaagttgatggttttacttaatcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggataactatgcaaaaaagcacactctacccccctatttatgttcttggtaacgggcaacttggcagaatgttacgttatgcaggtatgccattagacattgaagttcagccattagcctttgatgatcccgtattcgatctcgcagaaaacagtttgattaccgctgaaattgaacgctgggcagaaacgcctttaacaaatttattgagcaaccataaaaactttgtcaatctttccgttttcagacaacttgccgaccgttttacccaaaaatcattgctcgatcagcttaatctctctacatcgccttggcagttattaagttctcctgagcaatggcagcaagtctttgaaaacattggtgaaaaagtggtagtgaaacgtcgtacagggggctatgacggtcgtgggcagtggattgtcactaaagataatgtcgaacaaattacctctgatttatttggtgacgtaattgcagaaaaatttattccctttgacggcgaagtttccttagtgggtgcaaggttccgtaatggcgaaactcacttctaccctgtaacccataacttacaacaaaacggcattttacgttacagtgttgcggatatcacgctaccccatcaacaaatattccaacaacaagcagaacaaatgctctctgcgattatgcacgaactcaattatgttggtgtaatggcaatggaatgttttgtagtaggcgaaaaactgctgataaatgaactcgctccacgcatacacaatagtggacattggacgcagttaggctgttcaatcagtcaatttgaattgcatttgcgtgcattacttgatttaccaaccccagagcttaaacctattgcaccaagtgtaatggtgaaccttattgggatcgaacatcataatgaatggttagatattccatttagccaactgcattggtatggaaaagaagttcgagcaggcagaaaattggggcatattaacctttgccaccctgataaaaccgttatcattgaaaacttgcaaaaactcaaaccttatctctctgaggatttttattcggggttggattgggtaaaaaatatcatcgaacatacgtaatttcgttagccattaagaaagtttttgtaatttcgccaaaacttataataatatactgtacttctacttacatttcatatttaaggaataaaaatggttatattacatactaatcttggtgatatcaaaattatgctaaattttgagaaagcacctattacttctgcaaattttgagtcttattgtaaagaaggtttttacaataatactattttccaccgtgttattgataatttcatgattcaaggtggaggtatggaagtaggaatgatagaaaaaccaaccagagaaccaattaaaaatgaagcaagtaacggtttaagtaataaacggggtagtattgcgatggctcgtacagcagatcctcattcagccacctcacaatttttcattaatgttgtagataatgctttcttagactaccgaacaaaagaactatttggcaaaactgtagttcaagaatgggggtatgctgtttttggagaagttgtagatggtatggatattgtagataaaataaaagttatctctacacataattatggatggcatactgatgtccctaaacatgatatagtcattacttctgtaagtattgaataaatcacaatgtcctctattcctctctcaatctaattattttctactttaaaataatcgtgagtaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcaatggctggtttaggagctattgtcactggcattgatatggcagcagatgctctactagttgctagacaacatgcagaatctaatcacttaaatatttgctatcagcaaattactgtagaagactttctaaaacaacattgtataacggatactgaaaaatttgatattattacctgtatggaggtgcttgaacatgtacccaatcctcattctattattcagagttgtaagaatttattaaaggaagatggtttactctttatttcaaccattaatagaacagcgaaagcatacatgttaattattataggcgcagaatatgttctcaaaatgcttcctaaaggcactcacaatttcgaaaaatttattaaaccctcggagttgctaagatggtgctctcaagaagattttgaatgtaaagaaatcgtcggataccattttaatcctttaacaaagaatttttggatcaataaggatataaattgtaattatattgccgtactacaaaatagctaaaactagctacagtaatggcaaaaagagaaatgataaagtattaagtcaatagcataaaaggcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttcaactgtttcacattaacagcgtccgtatctgctaccccttcagcgacattacctaataccatcggagtttcatttgccaaattcacttttactgctaatgacttaagcgtaatactgccatctggattttgcgttttggttgagaatttacctttaacattcaccactggaattaacttaatcgaaccatctttagcaggttcttccaaatagaaattaccgcccatattgataattgatttgccgtcttccgttgyatactcgatcggtaaaccgctgacactcacatttcctcgctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgatattaccatcctttctaaaagtattgctaccaacagaaaccgcaccaatnnnnnnnnnnnctgtggatttaaatccattctcaacagtgcttccctctgtcacagaaaaagtttgttttgctccttcaatacccccttccgtttctgctttagagtaataacccaatgcaacaccacctaaaacgttaacagatgaattgttacccaatgcagtgcctctgagtttatttgcaatagcattttcaccgactgcaacagagcctgttcctcgtgcttgtgctccataaccataagccnnnnnnnnnnnnnnnnnnnntgcagttgccccaacggctacggcatnnnnnnnnnnnnnnnnnnnnnnataacctatcgcaatagaagtcctaccttcagcttttgcgttctgaccgatgacaatagaaccaggcccaacsttactayctytaccaataccaatagtaccatcgtcaactgattcattccctccgggtccagaaccatcttcataccatgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccactttttaccaacacttttgtctactatgtcgcataccaaatgcttaaaaagtgattgaagtagactaatcccagtataatctacttcaatattttcattatcttagtgcactcttcaatgcttctgctttatccgttttttcccaagggaaatgctcacgaccgaagtgtccgtaagcggcggtttcacgataaatcggacggattaaatctaacattttgattaagccgtatgggcgtaagtcaaaatgttcacgcactaaacgtactaacacttcattgctcactttgcctgtgccaaaggtttccaccataattgatgtcggctctgcaataccaatagcataagaaagctgaatttcacaacgatctgccaagcctgctgccacaatatttttcgcaacataacgtgcagcgtaagcagctgatctatccacttttgacggatctttacccgagaaagccccgccaccgtgacgagctgcaccgccgtaggtatcaacgatgattttacgtcctgttaaaccacagtcgcccattggaccgccgatcacgaaacgacctgtcgggttgataaagtatttggtgttttggcttaaccattcgcttggcaatattggcttgatgatctcttccatcacaccttcaaacacggttttctgatcaacgtgttctgcgtgttgggttgaaagcaccacagtatcaatgcctttaattttgttatcttcgtaaataaaggttaattggcttttcgcatctgggcgtaaccaatctaatttgcctgacttacgcactttcgcttgttgttccattaagcggtgagcgtaagtgactggagctggcattaacacttccgtttcatttgtcgcataaccgaacataatcccttggtcgcctgcaccttgctctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggttagcacgatccacaccttgattgatgtctggcgattgtttaccgatagcatttaataccgcacaagagtgtgcatcaaagcccatatctgaatgggtataaccgatgtcgcaaatcacttggcgagttaagttttcaatatccacccaagcagaagtggtgatttcaccgcccacgagagccatacctgtttttacataggtttcacacgctacacgtgctttcgggtcttgtttgaggatttcatctaatactgcatctgaaatttggtctgcgattttatctgggtgaccttcagataccgattctgatgtaaatagattgatagccataattattccttgtagggtacgcaactaacgcaccatgattgttatttggtgcattaacgcaccctaagaaattcaacaagcagtaagatattgcaaaaaaatacgacaatgcttaccgcttgtaagaaatttgttttagaagtttttccgtctagatggctataatacgttgtttaagtaataatgacaaatatttttttgaatatttatgctttctaaacatagaaataattctctagctcttagaagaaaaaagggggaggaccatttatgaaaatctcttaagaaatataggaacaatagtatatttattgcttttttcaaaaatcaccttagaatgtctgagttatttatttctacaggagtataaaaatgggtacactaggttatgcattattaacagttgttggtgcattaggcataattgtgatgtttgcaatcaacattttctaatgttgcattttatgaaatggtgagttgggtgactggctcaccatttttatttatgggataagctatgtcaaaaattacctttgcttctttaaattttaatcaatcaaatacccctgtttcagcacagtttgatgatatttatttttctacacaagatgggctggcggagagccattatgtctttcaagagggtaatcaactgtgggaaaaatggcaacgacacccccgatctttctttgtgattgctgaaacgggctttggaacaggactgaatttttttgcagtggcagaaaagtttaaggcatttttagcggaatatccgacttcaccacttaaacggctctattttatctcttttgaaaaatttccgataaaaaccgaacaattacagcaaattcaccaacattatccgcaatttgcaaacttttcnnnnnnnnnnnncgcttgttggcagcctagacagagcggttgtcagcgttaccattttgaacagatttaccttgatatttggtttggtgacctattagagaatttgccacaactgggagactattataacaatctgattgattgctggtttttagatggtttttcgccagacaaaaaccctgaaatgtggaacgaaagcctttatcagcaaatgttccgcctaacacaagcgggcggatcttttgcaacatttaccgcatcaagcaatgtccgtcgtggtttgcaagcggtcggttttgaggtgaaaaaacgtaaaggtttcggcaaaaaacgtgaaatgctttggggcgagaagcctgacaatcaaacggaaaaccgcattcgctttccttatttttatcaatctaaccaaacagagagcgatgatgtggcgattgtcggtggtggtattgcaagccttgctgttgccttgtctttgctagaacgtggcaaacaggtcacgctttattgtaaagatgaacggctggcaaaaaatgcatctggcaatttacagggggcgatttacccacagttaagcgacgatgatgagcgaaatgtgcgtttttatgtgcatagcttcgattatgcgttgcaacgttttaagcagttggctcaagcggtcacatttgaacacgatttttcaggggtggcattgtatgcttataacgataaaaccgcacacaaactgcaaaaaatggcggagcaaggttgggatagcgaactttatcaactctgctcagctcaagatttgagtgaaaaaataggcttaacggtacaaaatggtggtgcttttattgctcagggcggttggctttcacctgtgcagtttgtgcaaaatgcctttgctttattgcaacaacgaggcttgaaggtggtgttaaatcatcaggtggaaaatcctgtgtggcttgcaggaaaatggcaatggcaacatcaagggcaaacctttgcccatcaaaccttagtgttggcaaacgggcatttattaaccgattttgctcagagccacggtattcccctttatcctgtgcgcgggcaggtcagccaaatcccaacgacagaagccttgtcgaagttaaaatgtgtggtttgttatgatggctatttaacgccgagctcagctcaacagacccattgtatcggggcaagccatttaagagacaatgccgatgaacagttcagtttagtggaacacgagcaaaacattgcaaaacttcagcagaatttgaccgcttgtgaatggacgcaacagattgatttttctggaaatcttgccaaagtcggcattcgtgcggcatttcgagatcgtgtgccgatggtcggggctgtgccggattttgaagcacaaaaaacacaatatgccaacttgtataatcaacttcgccgtcgagagccgattgaaactgccaactgctatccaaatctctatttagtcgcagggcttggctcacgaggcttaaccaccgcctttttattgggcgaattattagcgagccaaatttgtggcgaaccgcttccccttagccaagatattttgcaagggttaagcacaaatcgaacctggatacggaatttgttgaggggaagagagataacataaagggctaaatatataggcatagtagacaaaatagttgctatgcccccaatgaaaacaactttatttgttcagacccctatcaaaagtgcttttgggtttcaagagaaagtaactttatggggcttatcaggcgggattatcaatatcaataaattcgacctctaatccatactcttttgccagccattcacctaaggctttcacaccatctctttcggttgcgtggtgtccgcaagcaaaatagtaaatgccttgttctcgtgccgaatgggtcgtttgctctgaaatctcaccgctaataaaggcatcgatctgtttatttgcggctaaatcaatataaccttgtccaccgccggtacagatagcaacagtcttaattaatttttgtggaaaatctgcaataaattcgtcacataaaatcggtttacgcttaagagctttttctagtctgttcgctaactcttgtgctgaaatcgcttcatctaattcaccatagacgggaatagagagagctttatcttccaaaccttgtaagttttttaccccaatatgttttgcaagttgagcgttgttgcctaattccgcgtgcatatcaaggggaagatgatagccaaatagattgatgtcgttgactagcagttgtttgatccgctttcctttcataccacgaatacaagggttttcgcttttccaaaaatagccgtgatgaacaaggattgcatcggctcttttcgcaatagcctgttcaattaagggtaaactagcggtgacacctgtgataattttgcgaatttcacgacgaccttcgacctgtaagccatttggagcataatctgcaatggctttactgttgagtttttcatcaagaatttgttcaagttgtagattaatgagcattgtcactcctctagggtgatcttttatctaggatatagatgcatacgccatacatttagcgaaataatttattgcttaaaagtcaatacgttataagtaattataaatttagatatggaggcgtgtaccggagtcgaaccgatctacatggatttgcaatccagtgcataaccgctttgctaacacgccctaagaaaatatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgaattgttcttggaaacggtgtgcattctacctatttctaaataagtgtcaaatatttattttataaaacaaaattaattgatgaaaaaaagggcattgattgtgtttatctcaataaatggttaaacggctgaatagtcacttgctcacctacggcaacattgccacgttcttgctcaagcacaataaaacagttgctttcattaaacgcactaaaaatatgcgagccttgtgttccaacggtttttacttcaagttgcccattttcattcgcataggaaaagccccgttggaaatcttggcgaccaacagctttcttgagtggaactgcggtacaagcggttagattaggagaaaaatttgcaatatgttcatcggatctgcccgctagtttcaataatgcaggctgaacaagttgatagaaagtgactaaagcagacacaggattacccggtaaaccaaagaaccacgctttttccaatttaccaaatgcaaaaggtttacccggtttcatcgcaattttccaaaaaccaatttgcccgagtttttccaagacatctttggtgaaatctgcttccccaacagacacaccaccacttgtgattaacacatcggcggtttgttgtgcttcggtgaaggtcttctcaaacagactaggatcatcaggcaaaataccgtaatcgacaattttacaatccattttttctagcaaaagacgaacggtaaaacggttggtgtcgtaaatctgtccttcttgtaacggatttccaacagacactaattcatcacctgttgaaagaatagcgactttcaaacgtggataaacagcaactttatcaatccctagcgaagccaatagtggtaggcttgctacatttaataggctacctttagcgagaaccaattccccttgcttcatatcttcaccaatacgacggatattatcccccaatttcttcggtaagcgattaatggtgacagtaccattggcattcagcgtcgtatcttcctgcatcactacggcatcagcttccactggcacttttgcccccgtcataattcgtacacagcttccttgtggcatttcagccagaaacggattacctgcaaaggctttacctgcgatttgtagcgtagtggaatgttctagatctgccattcgtaccgcatagccgtccattgcagagttatcaaaattcggcacgttaatcggtgagaaaatatcctcggcacaaattcggtttaccgcttgatcaagcggaataatctcttgtgatgttggacgtggtagttggtttagcatcgtatcgagtgcttgagaaagtggaagtaaagacattgggtgttccttaatataagtagtagggacacactgcgtgtgtccgccaaattgtgaggggcagtcttttttaaatggacacacgcagtgtgtccctacatctatttatgacataattttgttgtaagtaatacatcaccccatctgtgcctgtgtaataaaatctttcaaccccagcaagatattattaatcgctaccgcagaaagaattaagcccatgacacggctgataatggccgcaccggcatttccgataaaatgctgaatacggtttgccattaaaaagagaatataggtaatcagcaatacagataacatgataccggtagtaatcacctgattaccaaaactataacgatggttatccgttaataaaactaccgccatcatcgcccccggtgatgcaatcgacggtactgccaagggataaaccgctaattcgtgtaaattgctgcgcatttttatttcttgatccggtttactttcaccaaagatcatcgttaaggcgaaaagcaacaaaaccaatcctccggcaatttgaaatgccgataaagggatctgcatcgcatcaagtagccattgtcctaacaccaagaaaaagagtaaaatcccagccgcaattaaaatcgcattacgggcaatcttacggcgatcttctggtgataaaccaacggtttttgccaaataaactggaatggagcctattgggtcgatgaccgcccaaagaacaacgaattggacaactaacgaatcaaacatttacttttccttataaaacaaaatcttcgttattgtgcaataaatttaccttaaaaccaaacaacttatttaattttcaatgattttttttacagatttaaccttaaaacgtggtcaaaccatcttacttgaacaagcaaatgcaactattcatacagggcagaaagtcggcttaatcggcaaaaatggctgtggtaaatcgtcactgtttgccttattaaaaaatgaactacaagcagaaggcggtgatgccagctatccgaaaaactggtcgattgcgtgggtaaaccaagaaacacccgcattagatatctctgcgttggattatgtaatccaaggtgatcgggaatatacccaactcactgcccaacttgagcaagccaaccttgagaataacggcaatttgattgccaccttacacgcccaactggataccattgacgcttggacaattcaatctagagcttcaactctacttaatggcttaggttttagtaccgaacagcttcaactgccagtaaaatccttttcaggtggttggcgaatgcggttaaatttggctcaagctttaatttgtcgttccgatttgttgctacttgacgagccaaccaaccacttagatttagatgctgtgatctggcttgaacgctggttaagcaactatcatggcaccttattgctcatttcccacgaccgagattttctcgatccgattatcgaccgagttctgcatattgaacagcaaaaattgtttgattacacaggtaattacagtgcgtttgaaatccaacgagcgacgaaactcgctcaacaaaatgcagcttaccagcaacagcaacaaaaaatcgcccatttacaaaaatttatcgaccgctttaaagccaaagccaccaaagcaaaacaggctcaaagtcgtgtcaaagcccttgaaaaaatggaactgattgccccagcttatgccgacagcccattttcctttgagtttagagaaccactttcactgcctaaccctttgttaatgatggaaaaagtcagtgccggctatggcgagagaaccgtattgcaatcagtcaaactcaacctagtacctggttctcgcattggtttattagggcgaaacggtgcagggaaatccaccttaattaagctacttgcaggcgaaattcaagcacaatcaggacatacacaactagcaaaaggcgttcaacttggttacttcgctcaacatcaattagacaccttgcgagcagatgaaagtgccttgtggcatttagctcgccttgccccagaaaaaaccgaacaagaactacgcaactatttgggtggctttgcgtttcacggcgataaagtcaaacaaacggtcagttctttctctggcggtgaaaaagctcgccttgtgcttgcgcttatcgtatggcaacgcccaaacttactgctactcgacgaaccgaccaaccacttagatctcgatatgcgtcaagccttaacagaggcgctgacacaatatgaaggatcgttggtgatcgtatcccacgaccgccatttattacgcagtaccgtcaatgaattttacttagttcacgacggcaaagtggaagaatttaacggcgatttggaagactatcaaaaatggctaaatgagctaaatgcccagttggaatgtgcaaaaaaagcagacaatccgaccgcttgtaacaatgaaaacagtgcggtaaaccgcaaagagcaaaaacgccaagaagccgaattacgccaacaagccgccccactgcgtaaaaagctgacgcagttggaaaaagagttagagaagctcaccgctagtttaacaaccctagaagaaacgctggcttcccccgaaatttacgacgtggaaaataaagccaaattgacagacactttggcaaagcgagtggcaaccaaaaaacagttggaagaagttgaaatggaatggctggaagttcaagagcagttggaagtattgatgaacggataatttaaaatattagcatagtagacaaaagtgctggttttaattatttcctttaattatcaccaacattttggtctattatgccaaatgttttcgtagcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacaagctgacgacggcgaaccacaagggcttttttaaggggcttagtttttactgaaccagcaacgattttgtctactatgccgaaagataatacaatttgagaataataaaggcagaagataccctctgcctttattagaaaactacagtttgccttctgcttctcggcttgcaactgcatcgcctaaatcctgattatccacagatttttcttcaggtttatcatcttgaaccgttgatgctttatcttcatcatcgttccccgaattactccagcctgatggttcaccaacaggtctgcggttcattaaatcatcaatttgcttgcgatcaagcgtttcgtacttcaataaagcatctttcattgcgtgcaagatgtcgatgttatctaacaatgtctgcttcgctcgctcatagttacgatcaatgattttacgcatctcttggtcaatcaaattttgcgacgcttcggaaacccctttaattgctcccattccatcttcattttgatagaacaatggccctagctcttttgaaaagccccattgcgttaccatcgctctcgcaatttgtgtcgcacggtgaatatctgatgaagcccctgtggtaattttatcttcaccaaaaataataccctcagcaatacgccctgcaaataaggtagaaagttggctttctaatttcgtaaaggtttcactaacacgatccccctcaggtaaaaactgcgcaaaacctaatgcttgcccacgaggtacaatagtcactttattcagcggatcgtgttctggcattaaataaccaacaataacgtgtcctgcttcgtgataagccgtattgataatctctttttccgtcattgtatttgaacgacgttctggccccatattgattttatctctagctttctcaaaatcgtccatcgttacaacacgtttattttgacgagctgcaaataacgcagcttcattcacaaggttagcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacaaggttagcaagctgagcgcctgaataaccaggggtaccacgagcaacaaccatcggatctacatctgctgcaagcggtacttttttcatatgaactttcaaaatctgctcacgtcctttcacattcggtagatctaccgtcacttggcggtcaaaacgacctggacgagttaaagcgttatcaagcacatctgcacggttagtcgcagcgataataataataccttcactaccctcaaaaccgtccatttccacaagcatttggtttaaggtctgttcacgctcatcgtgaccaccactaaaacctgcaccgccacgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcatttgtagaagctatgattgtacaatcctcagaaataagggacgatatggattccataatcatatgatattcatccaaaagaaggttttcatctgatgtaattgagataactgcaccatttatttcttttattttcttgtggctttttgataataaatgagtaattacatcatcagcactaattgtctctccttttcgctctatttcaaaagagtaaaagtctatttcttttgcaccataagaaactgttttaatatcttccacatcaacattaattaaattattctctgaaatcaaatctattattactgtaatagcatcaaataagtccgtctctttaagtaacatacagtctactggtaatggcttatttaatgcaataaggatatctatgcgcttttctaaatcaagtagccacttatgacaattactatgcagactttctcttcttgttggtaatacgactacagataagcaatcaaattggaatgattttgcaaactgataacacagctgtaaatctctctcattattttctacaaacagaagtgagaatgcttcagtatccactgccataacttctgtaagttgctcaatataatgaaaagatgtaacaagcggtgaattttcgtgattttttacgaactcattaccttgcaagcctatgccggtaaattgcacttttttagacatatagatctccttgttgattggagctattaaatataatggttaacacgacaagatatgtcgcatgaaaattactttaaggcttgttaatgttttgtgcttataattttatacctagcacgcaaaatgcgtactaggttacgtatagttgagtggctttgccactctaattctcagccccaaaggggctgaattatgcgtaacccagtacggctctgacgtgctgggatattaaataaacacctcttgatgattttgcaatctcaaaacatcaacaagccctagtttgtgccaaatttctttttcgccgcttcaacaatttcgttaaaaatcggatgggcttcttttaacgtttttaacgcatcacgaatcggctccattgcatcttctaaggaatcaggatagttttcaatgactagcttaggatctaaagatttaattggtagataaaaatcatagcctttagtattaaatttaaagcctaattttcctagctcaggatattttttattctgttctatcatgaactctttccaatctttattgccgcattttgggaattgttttttccaactatagaatcctaaaaccattccttcaacttttgaaaataaagaagtaatcccccaataatgaatttttttacccgtttcatcacattcaaaaccaaaataataatgagcgtagcaattatttgcatccgtatcatctgacgaatttgctaaccagtatgaaggataaaatgttgaaaatctattttcagcagaattaaattttcctttacactcaaaatcaaactcgaactctttaatcacattatctacagcattaaaaagctcagaatcaaagtcatcattaattaaatgtgaagcttcatcaaacatctgaatgttttcaatgattaatttgaaagctgcttgtctactcattttagtttccctcatattaaaaagttaagatgtgttctacaaactgttcggctaaccataaactgcggttatttggattttttcttagctcttgtcttatttgcttctgcaaaactttcgcaaaatgcgtccaagaaagacctataattttttctttatccgataaactttgtttatcttcctgatcatatttaacaataccatcttttgttaaataaataattttccattctcttgaacctgcttttattttggcaacatcatgatatctttttagctgctctttaccttctaaagcatcaatttttacctcaataaatagcaacacttcgtcagattcaatttcaatatcgactcgttcactttcatctcctaaaggacaacattcttccgttgcccgataaacgcttgggaaaggaaaggatgacttatcccaacctagactgtcatacaacgcttttaagaagaaacttccttgtccgtgatcttcatgcatatctaaaaaccagcgtaaaactttactattgcgaacctcataacgccccaagtttgcggttttccatacattaaccttcatgcctaaagccttttcttcttccatcggtactcgtgcttctttatactcattaaaaaagtattgtaatttttcacgatcaggaatcactaattcctttttttcttccgaaggctcaagaaaaacaccctctttccacattttaaaaaatgtagctagttgagcgatgtccaatgttttatctttatcttgattaaaatttactgataaatgcatattttacccttcaatcaaatgattaaatcttgttataaactgattatattcagcaatgcgacaagatatgtcgcactaaacactctctttctgaatatcccaaatatcttctccaaaacgtcttatccaccattgcaacatatccgtatcggcaacggtcgcttggaaacggtaatgttcttcgctttcttcgagtgtaatttgatcttttgaaagtggcgtttcggttaaatggaagccagcccagcgagtaatggaaaatgttagtttcactttcccaccactgccaaaacctaaatgcccttcatcttggtactgttttaagttaaagtcttttgggcgttcaaagctaaaggttgataattcagcctttttaatacgatgtaaggcaagtaagcggttatcgtcaaacccatcataacgagcgactaaataggtgcttgccccttgttgggcaatcgccaacggcataatttgtgctttatgttttttaccagtttggttttggtattcaatatgtagtaacttattttggaaaagtgcggtactgacagctgtaaaaacgtcctctttcactttggctgggataagtggctggctagtcggtacgctacaaatttttccgagccattgatgttcaggattactcgtccctgctcccacaattttttcagcctgtttaaaaaagggttccattgacgacataatattcgcaggcaagagatatttaagttgctgttccgctaattttaagattaacgcttgttgttcattcaacatcggcacggaaatgccgactgatctctcaagccaacaatacgcatattcattgtcacgatcatcacattccaaatcgtcaaaatgctcgcttaaggtttttaatgcacgctgaatacttcgcttatctttttcaaagcctgcctttttcatactatcgaatatttcagacgtagttaaacgataaggctttttggggatacggcgtaaaatctctaataaaaagagtgtagaatcaattcctgatgggcgtttgggcataataatctccgcgtactaaaattgtggtagttttatctgttgcattgaatgaaagcctaaagcccttgtaatacagggataagttctggctgttgctcaataatcgcaagcaatttccgtgcagcgccatttggggttcgtctgccgatttcccacgactgcacaagattttggcttacgcctaaaaggggagcaaattccgcttgtttcatctggtgctgggttctaatcgctttgacattcgggattttatggatatgaatacgatgcggtggtacttctatttcgcctttttcaatggcgaccatttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatagtaaatcacccttacaccaccacttttgcccttgttattactttctagtttccagcgaattttttggcaaccacccgtattctgaataaaattgcctaattcgtgagattctaataaataagcctgaaatttctgatattcatcatcagacattaatgcttttcggtcttcttcaaaaactttggttttaataaaagtaagatattcttctgtttccattcaaaaaaccttagtataacgtacacagtacaatttttcagctattttatagcctaaggtataaaaatattttggctagcttgctttgctattttttcgatagcgatcgaaaaaatcataaatttctcagacagtctgcctgaaatccgctataattttctaggtatatcggtgcatttcgcaccgctttttatttttatcaatacgagaatctatgttccaaaataaccccctattagctcaattaaaacaacagattgaagcaagcaaagaatatgttgaaggcgttgtgaaaacgtcagataaaagttatggctttttagaatgtgagaaaaatagctatttcattccccctgcggaaatgaaaaaagtgatgcacggcgataaggtcaaagctgttgtgaagcgtgatggcgataaagagcaagttgaaattgactcgttattagagccaatgttagaacgttttatcgctcaagtgcgttttaacaaagacgggaaattgcaattagccgttgatcacccaagtatcaataactttattccagccaatacgcagaaaaaagtcacagaaccccttgaaaatggcgactgggtggtggcacagttgaaaacacaccctcttcgtgatgatcgctttttctttgctcaagtcacgcaatttatctgtaaagcggacgataatttcgcgccgtggtgggtaactttagctcgccacgaacagcctcgtgaacctgttgcgaatgagaaaagctatgaattacaggatcaagtcgagcgagaagatctcactcacctctattttactaccattgacagtgccagcactaaagatatggacgatgcgttatacgttgaaccaattagcgagaacggcacgcaaacaggctggcgtttagtcgttgcaattgccgatccgaccgcttacattcctgagcagtctgcaattgaaaaagccgctcgccaacgctgtttcaccaactatcttcctggttttaacattccgatgttgccacgagagctgtccgatgatctttgctctctcgtgccgaatgaaaaacgcccagcattagtcggctatattgagacagatttaagcggtaatgtggtaggtgaagctcgctttgtgtcagcttgggttcaatctaaagctcgtttggtctatgacgaagtgtctgattatctcgaaaaagtcgaaaatcactggacaccagactatgcagaaaccgcacagcaaatcgactggttgtatcaatttacccttgctcgtatcgactggcgtagcaaaaatgcattgctatttaaagagcaaggcgattacagctttgagttagctgaagacggcgcagtcaaagcaattcacattgaatatcgccgtatcgctaaccaaatgatcgaagaggcaatgattattgccaacatctgtgccgcacagtttttagataaatatgcacacacaggtgtatttaatacccactcaggttttgatagcaaaaacctagagcctgctcgcaaattcttactggatacactttccaatgatgaaaatcgagagagtttatctgaacgctactcccctgagcgtttaagtacccttgaaggctattgcgaaatgcgtcgtgatattgagcaattccctgaaaatttcttagaaatgcggttacgtcgctatttaacttttgctgaatttaaagcaacctcagctccgcatttaggtttaggcatcagccattatgcgacttggacatcgccaattcgtaaatatggcgatatggtcaatcatcgtttaattaaacaagtccttgcaaatcaaacagcaaaacctgtcgaagaaaccgttttagctcgcttacaagaagctcgtaagcaaaatcgtatggttgaacgtgatattgccgactggctttatgctcgttatcttgcgccaatggtagaacaaaacgtagaatttgacggtgaaatccacgatgtttctcgtggtggcttgcgtgttaaagtcattgagaatggagcttcggtttttgttccattctcaactctgcataataacaaagaagaaatgnnnnnnnnnnnnnnnnnnnnnnnnnnntacatcaaaggcgaaaaagcttaccaaatcgggcaagcggtgaaagtgaagctcaaagaggttcgtgtagaaacaagatcggttgtgggtgacgttttaatctaaataagattcaaaactatttccatgattactctcctctgtcctttatgacacttttatgaacatcaggtaagaaaaaattttacctgatgtatatttttaagggaacaaatatgttttataaaacttattcaaaaataattttacttagcaccctaacattatttactgcttgttctacaaaaatatctgagcagcctaatacagaaataacaaaattaggagctaaatttcaccaacgtaaatttattccatctaatgtaccattagtgaatatatcggatattcagataaataataacattgttaatcaaaaggattttttacaacaacttgctcatattcaaaaccattcaactaacctaatgaagcatcatgtaaaaacatataataagctctttacttggttatcccatggaggaaaaattaaagatttaaaacattacggagtccaaattcaacaaatgcgagggcaggatgggtaccaaaatgtactaatgacgggctattatatccctgtaatcccagcaagaatacgtccagaaggtgaatttcatcatcctctttatgcaattcctaaagggaataagaaatactcaagggctcaaatttaccgcggtgcgctggctggcaaaggtttagaattggcttatactaattcaatgctggaaaactttttgatggaagtacaaggtagtggctttgttgatatcggtggtggtaggctacatcatttagcctacggagataaaaatggctatgcttacaccagtatcggtcgtttgttagtagaagatggagaaatagcgaaagagaatatctctattcaagcaattcgtaaatggagtaaagaaaatcctcacagattgcagtcactactggaaagaaataattcttttgtgtacttccgccgagatccaacactagaagtaaaaggatcagcaagagtcccattagttcctttagcatcagttgcatcagataagcgcctcattccaacaggaagtgtattattaattgagatgcctatacttgatcacaatggtaactggaatggtcgccatgaattccgcctaatggtagcattagatgttgggggcgcagtgaagggacaacatttcgacctttatcaaggaattggacatcaagcaggacaaaaagcaggtcatatgaaacattatggcagagcttggctactaaattaggaacataaaatttgatttttatcataaaaataaaaaaattatgtttttatgcaaataaaatttggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgatartgctatkcgwaccatctgtataggtaatttttasatcgccatttgkttcatttaccacactttcaattaacttacccttagtggcaatggtgatattaccgttctcttgagttagtttaatattatcgcctgcagtaaattttaccgtatcgcccattttgataagatgtgccgcaggtkgacttgcttgaccarccyctttcgcaatcrtcagtttccaacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaatttgaaaaactcaaaaaattgatgtaatcttacagcaacaaaaataagtgttatgtccaataacccaaatcacaaatttgctttccgagtagcccctgttataggggctttttttatgtttttcaatttactttatgagactttttccatttccaaaatacaatggctccgccaatcaataacataagccaaattgccatctgtcctttttgaatttgttgatgtagccagtctaggttctttgcaccgaagtcccctaaatagacccaaattggtacagaaataatggcagcaaagaaatccactaacacaaagcgagtaaaggtcactcggcgtgtgataccagaaaccagatacaccacagcacgaagaccaggtaaaaaacgtgctacaaaaagcaatttccagccctgtttttcaaagcgttcctgtactgttgcgaagcgttctggggttgcaatacggcgaataagaggaaattgcaaaatcttctcgccgtaaatacgacccaaccagtacatggtactgtcgcccactaatacgcccagcatactgacaaacaacatccaatgaacattggtgtatcctaaaccagaaatcaccccaccagacactaatgtgatatcttcaggaataggcaaaccaaagccacaggcgagtaagactagaaatactgcccaataaccatagctgctgaaaaactcaattaatagttccattctaacgtccttattgatttaggttgcgaaccgaactacgcaccactaattctggataaaattccaatactttaggagtaacaggctcagacggttgctcattatgctgttgaatacgctctaataaggtatcaattgccatttgccctaaacgtgttttagattgatgaatggttgtcaaaggcggtgcatagaaacgtgaactatggatattatcatagccaatcacggaaatatcctgcggaacagaaagccctttttctgtaatggctgaaatcacacctaacgccattgcatcacaaccacagatcacagcggtgggtaacttatcctgtttgagcaaattattcatactttcataaccgccctcaggctgaaagtcattttcaaaaatccactctttgcggatcaacagacctgcttccgtcattgccttaacaaaaccatcataacgggcttttgcggttgttttataaagataacccgcaataatcgcaatatcacaatgtccattatcaattaaatgtttggttgccatataaccaccatcaaggctgtgatctataatacggtcactcttaccatcattcggaccccaatccataaccaccataggtacattcgtgccattaaataacgccaaggaattttccgtatattcggaacacattaccaaaatgccatcaacccgttttttaattaacatatctaaatggttttgcactttttccgcatcattttgagtattacataaaaagagtgaataaccttgacgatagcagtattcctcaacggcaagcacaatttccgcaaagtacggggcttcgctcgttgtaataatcataccgattgattttgttgtattcacttttaagcttcgagcaacggcactaggcgagtaatttaggctggcaatcgcttcccatacggcttttgtagtatcttctgccacaaagcgagttttattgataacgtgagaaacggtagtggttgaaaccccagccaatttagcaacatctttgatggtagccatggatattcctcctaataaaaattgggttctattataacgaaaattttctaaaaattactgaatttaatctttatatacgtactaaaatacaggaaatataacaaacccgatgagttaaaagaataaatgtctattcgccactaactgctcacgggtcaagctaaacacccctaacccaccatttttaaattcaagccagtggaatggcacgcttgggaattgttcaattaaatgaaccatactgttacccacttcacagactaatacgccgtgatcggataagaaatctgccgcttgagctaaaatgcgtttggtaatatccaagccgtccgccccagaacctaatgccatttcgggttcgtggtgaaattcttctggcatatcgtctaagtcttcttgatcgacataaggcggattagtcacgattaaatcatagcgatcttgtggtagatcgttgaacagatctgattggaatgggaatacacgatgaggcatattgtatcgttcaatgttgatttcagccacatttaacgcatcaacagagagatcaactgcatcaatttccgcattcggaaatttgtcggcacaagcaatcgcaatacagccacttcctgtacacatatctaaaatgcgttttggttcagctcgtaagatccccgtaaaaccctgttgaattaattcaccaataggggaacgtggcactatcactcgttcatcaacgtaaaactctaagccagagaaccacgcagaatttgttaagtaagcaacgggtttgcgtaagcctaaacgttgttctaccatttcaacaatgcgttctttttctacacgggttaagcgtgaagcatagagtgtttctggcacatccattggcaatgcaagagaggttaaaaccagttgattggcttcgtcccacgcattgtcgtgtccgtgtccgtaatagagatcagaggcgttaaaatagctgtatgcccaacgcatcatatctaaaatagtagcgagatcgtcagcgacaggcgatgaagcgatttcatcaagaagttcaaggttatgttcgtacatatttaatacctattttgaaaaattgccgttttataccatatttccctttgtgttagaatgggctgattaatttaaaaggaaagattatgttagaaaatgatgaattggctttgtttcgagaagcgattaagggaacaaagaaaatcaaacaagatacctttgttcctaaagttgaaccgcgtaaaaaaatcaatgagatcagagaattaaaagaaaaagcggatacattgttttatttttccgatgaatatgagccgttattaaccgaagaaaatgataaagtgaaataccgtcgggaagatgttgatccttatattttaaaacagcttcgtcgtggtgactttcaccctgaactctttttagatttacacggtttgaccaaagaaaatgccaaaaaagagctggcaagtttaattttagcttgtgagcgagaagggatttattgtgccagcattatgacaggctatggcacaagggcgttgaaatatcaaatccctcgttggcttgttcaacatccgaaagtgattgcattacaccaagcaccgagagaatggggtggtaactccgccattctaattttaattgagcaaccagaaaaattagataaaaaacgataagaagctgtctttttaccctaagaatattccaataaaggcatagagacaaaattaaaggaacctgatatggatctgcacctcaaagaggtttggctttaccaattaactaaggtgcagaatagaaacctaagcaatatacctctaaccagcaacagtaggtaaaataccgttttgcattaggaatgggataacaataatcacaatacccataatgaaagccaaaattaaaccgatagaaccacctgctacacggtaaggtaagttagggtgtgcttggcgagctttccacgctaaaccgataggtaaaattaacccatagaaagcaaagagtaaacctgcataacctaaggctgcaataaagccatttggatagaataaggcaaatgcaagcggtgggataaaggttaaaggtgttaaaatcgctcgatttgctggcaagtttacacgttttagtaaatcgccaaccccttcaaaaatacccattgctacccctaagaaggaggtgattaaagccaacgctgagaaaatacgcaccatctcgcctaaaatggtactgcctgtaatttgacttgttgctttaactaagccatttagggttggatcttggtttaataaggtgacaaattcgccttggcttaatacgccgtgtgttgctaattgccatagtaaataagcaccgagagggatcactgtaccgataatcaccgcaattctaattttacgaatatccgcatcaaggtagctattgatactacccataataacgtgaaagccgtaagaggtgaagaaaatcgggatcgctgaaataactaataagttatctagtggcactgcggttaagttctctaattttgcttttggaaacatcattaacagtacaaatacaaatgcaacgattttaccgataaaaagaacacgagttaaaccgtctacccctttaatacctacgacaacaaatacccctaaaataaaggtgaaaagcaaaatgccaacttttaaggtggtatcaccttctcccatttcaggtaatagtcctgaaacaagagagccaccgcctgtaatgtaggcagctaaaagtgcataaagcagtacaagtaagcacactgtcgctaatacgcgaccaggcattccaaaatactgttcagcaagggttgctaccccaacatcttgctgtgcggcggtctgatagacttccataaacagtaatccagtataagtgagaagcaaccataatcccaccaacaataccaacgtcattccaaagcccattcctgcggaagttaatggcattgctaacattcctgcaccaatggttgtgcctgcaatcattaaggcactgcctaaaattttatttttcataaaaactcctgaaataaaaatcctaggcattctagcaaaacaaaattaaaacgtaacgaaaaactctcaatgtaaaaaaattattacactcagtgtatttttttataatacaaaatgacttaatttttgtacttgctattcaacaaattatccaaccacttttggtagccatccactttcaatcaagaatggtaccatcacgataaataccccaataagtaaagcgagtaatagggaaatagaaccaccttttacttgatatggtaaatttagattttgacgacgtaatttccaaaccattgcaattggtaacacaatcgcatagaaagcaaacatttgcccagcatagcctagagctgcaataaagccttgtggatagaagaaggcaaataacattggcggaataaaggttaatgcacctaaactcactcttcctgcatttatatttacacgttttaaaagatcttccaatgcttcaaatagaccaagtgccacacctaagaatgaagtgatcaaggctaatgccgagaaaattcgcaccattgcaccaataattgaactacctgtaatttgtctagccgcttcagccaaaccatttaatgtcggatctttttccaaaatttgtaaaaattctgtttgagttaatacgccgtgcgttgccaattgccataaaatgtaggcaactaacggaatggatgtacccacaacaatagaaatacgcaacgctttcacattgccttctaaatatttgttcaaacttggaattgaaccgtggaaaccaaatgctgtaaagaaaattggacttgctgaaattaataacgcattatcaataggcattgccattaagttatctatagatacgtttggcaagagtaaaaataacaccaagataaaagcaagaatcttagtggtaaacaatagacgatttactgcatcaacactggtcgtacctaaaataataaatacaccaaatacgagtgtaaaaatcacacctgaaatacgtgtagtggtttcagcatcaataatagttggtaaaaatgcagcaagaagtgaactaccgcctgatacataagcggataaaatagcgtaaagaaatacaattaaaacggttgttgaaactatacgcccgaaagggccataatatttttctgccaaagtaccaagccctgcatcactgtccacagtttgatacacttcaacgaataataaggcactaaagcaaagtaataaccaaagtgcaaccaaaagtaaaaacgtaaaaccaaagccgatacctgccgatgttaaaggcatagcaagcattccagccccgattgtcgtacctgcaacaattaaggtacttcctaatgttttgtttttcatacaattacctgtcaataaaaatgaacatgtatattttaattaaaatacagaatttagctagaaaaatcacacggaatagaaaaatatttctaaatagtaaactttcttttacaaaaaacatgctatctcaaaatagtactactgactcttcatcaaaagagaaaaagtaatatctcaaattataggtactttttattagaaaaaatcaatttactaaattatcgctttagcattatttatactcttagtagagagatagcataatgtgtgtaaaatatcttggggctgtcctagataacgactaaaagctctataatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttagcttataaaaaaataaacctaacctaacggttcattttatatttgatcgttagattaggttttattttttattttgagttaatactttcagtaatttgtgtcgttgataaatgccctggtacaacttttttaacgtttaattcagaatctaaaaaaacattggaagggtaacctctgactttggctcttttcagcacttcaccttgttcatctaatagtacaacgacatttttatagtccagtcctttataccattcaataaatttttcagttgatttttccccttttttatctggagaaacaatagtaataacttcaaaatttttattttgatcagcgcttaaatcatcaatttcagccaagccagccaaacaaatcggacaccaagatgcccacatttttacatagacattttttcctttatacttttctaaagaaacgatattgttatcgagatctttaaattgaatgtctgccaaatttttattttcttcagcaaaagcattaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttcagcaaaagcattaaagctaaatagcatgagaagtaagcccattatttttttcatcttatatttctcctatattacataaaactatgtaagttattagtgattaacaataatcccattaaaataattagtgttccaccaatgattttaaatttatctaagtgcttgttaagtgatttagctctttttaataattcatcagaaaagaatgaaaagataataaaaggtagggctaaacctaatacataaacaaacatcattgcaccaccgtatagagcagaaccttcatcgcctgataatgctagcactgaagctaaaattggtccgatacaaggcgtccagccaagactaaaagttaaacccaatacaaaagcttctacagaagcgcttttaccatttgttttaatttcaactaatttagtttgttctaagaaattgatttttatgataccaagttgatgaataccaagaataataacaataattccagcaataacacgcgtaatatcatttaataataaatcacctaaaaagccaaaactaaaaccaaggctaacaaatgtgagtgataatcccataataaataggagtgtatttaatacctttttaccacctttacttaatatgccaaaatagatgggcacaattgggaaaatgcaaggagataaaaaagaggctaatccagctaaaaatacactgctgatgagtaaattctggtcgaacattttattttcctttgattaagttaattaaatatccataattttctttttccatttgctcaagaggaataaatttaatagcagcgctgttgatgcaataacgcaatccacctttatcttgaggaccgtcatcaaatacgtgacctaaatgagctttaccgctgcgacttaagacttccgttctaatcatattaaaactggtatctttttgataagtcaccacatttttgtcaattggttttgtgaaacttggccaaccgcagcccgaatcatatttatctctagaagaaaatagcggctcccctgtggtaatatccacataaagtccatcttttttgttatcccaatattcattactgaatgaacgttcggtattctttttctgtgtcacactgtattgtaaaggtgttaatttagcttttaattcttcatcacttggctttggataatctttaggatcaataataatattatttgcttgttctaaatcaatgtgacaataaccgtttggatttttctttaagtaatcttggtgatactcttctgctaagatgtaatgtttaagtggttcaacttctacttgaattttgtctttatatttcgtttgtagcgcttcaatttcttttagaataatagctttatcttgctcattttgataataaattcccgtgcggtattgtctaccacgatcatttccctgtttattcaggctagtcgggtctatgacctgaaaataatatttaagtaatttttctaatgaaattttattagcatcgtaagttatatgcacggtttctgcatgatcggtttttccgataatatgataatgcgttttatcggttttaccattggcatagcctgacgtagcattttttacgccataaatacgttccatataggcttcaattccccagaaacagccaccagctaaataaatttcacgaatattctcattttgagtttgtgtcattttactcatttccttacttgaattattagtatgatttattgctagagaattattagatatagcagacataataagggtaaataatacggttttatgagatttcatatattctccttcgaattttctctaattctgaaataagcagtagaggtattagtgtgtaaatatactactgctcgatttattagaattatttttagatggtaaattacatcttttcttttttcattttgtcagatttcatcatatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattccatcctttttcatatcatcagayttcatcatatgattttttttcatttcagaatgtttcatattttccatagtttggcaatctgctctcattttatttttgcaatcatccatcatttctgcatttgctgtattgattgtagcaatagaaactaaagaagttgtcattaatactttaagtaaagttttcataaatttttcctcttgtaaaaagatttgttaaggttaagataggttagtttttacgaaaagtttccctttcaccttattagtcggtgtaagagggaaatccttacaaaaatttttcatttttttagaaaaatatataacactatgattttaaaagaaattaattcatctcaaatggcagcaattagagaacaaatgctaaaatttgctcatcttcagctacgagacagtcagttagcagaagatatggtgcaagaagcattgctcaacgcacttaaaaatttagatagttttaaacgtgatgccgcatttaaaacttgggtatttgctattttgaaaaataaaattattgactatctgcgtcaaaaagatcgtttagttcttgaaagtgatttgcgagatgatgaaaacgatagcaatgtattttttgatcaagatgggtattggcgagaggagtgttatccacaagaatggcaacagcccgaaaatgccgtttattccgatgaattttggattatttttgaactgtgtctcactaaacttccagcaaaacaagcgcacgtgtttatgatgcgagagtatttagaactctctgctaatgaaatttgccatacagcagaaattagtcaagccaatctacatactttgttgtatcgttcacgcttacaattgcaacaatgtttatccagtaaatctatttttgggggcaaaaaatgaaatgtcaagaagtgacgaaattggtctctgaagctcaagaaagaccgttattgcttaaagaaaaaataggggtaagaatccatttattgtattgcccacattgtcgtaaatttgaaaaacattgccagcaaatgagccaattaatgaagaaatttgcagacgatcaaaataatgctgattgatgttttgtgtaataaagtagaaaaacaaaaacagcttgttatttttatgttagaatttctttcaatctaaaaacaggagttcaaaatgggtacatttggttatgcaatgatggccgttattgcttctttagctgtagaagatcaaacctaatctgacagtccccgcttaaaattaccgtgtctgtcagattaatttgagcttaaattcttttctgcccaaatcccttttccatcaagtaatgttgccatcggagttctgccacagcacatttttccttgatgtgttcgatggtgattataatacattaaccactcatctaaatcagcttgtaatgtcgctaaatccgtatatattttcttcctaaatgcgacttggtaaaattcttgtaagatagtcttatggaaacgttcacagataccattcgtctgtggatgcttcactttcgttttagtatgctctatgtcatttatcgctaaataaagctcataatcgtgattttccactttgccacaatattcactgccacggtcggtgagaatacgcaacatcggtaatccttgggcttcaaagaacggtaggactttatcattgagcatatctgcagcggcaattgcggtgttcattgtgtagagctttcaaaagcaaccttgctataagtatcaacaaatgtttgctgataagtaagctggaaaatccaaggcaaattttacaaccgcttgctcaatgtgctcgtctactcgatttttgatattcggtacccgacgagtttgattaagtaatgcttcaacaccgccttgctctacggcttgttgatagcgatagaatgtatctcggctcattcccatcgctttacaagcttgagaaatgtttccgagctcttctgctaaattgagtaaaccagtcttgtgtttaatgagcggattgtaagtaataaaacatgagagtttccttttttgtttagattgaattttagacactcatattctaaacgggaaactctcatttttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttcaggcaataaaaaagccccaagcatttctgctcagggctacaaaatcattttgctttatctcgcttgtacgagttgcaagcgtagctaaaatatacaactttcttcgccaccagtcaatcactttttgagcaattaaaccccatatagtttcttaaatattaaatgcttgattgtgtgtatttatgtgtatataattattattgattaagacaaaggaggaagcatgcactcaagcgacttaatcaaggaactaaaagaggcgggttgtttctttgttaggcacggaaaaggcgatcaccaaatatggcaatcgccgattacaggaaagcgatttcctgtaccacaccctaaacaagatttacctattggcacttcacgttccatcaaaaaatcggcagggctgttatagctctgccgagcttagcaaaggagagaattatgttatttaccgttggggtagaaactccacataatgagaacgaagcatttggactttgtgtacctgcactatttactgatgaatatagttgctttagtgcggccgatgcaattgatgaaattatccctaacgtaaaagatgccattcatacaatgttagaaatgatggtagaagatgagtttgatattagtacgcttcaagataagggatttgtccactacaaacaacaagaagatttttcccactgtgatagttggttgcttgttgatatagatatttctgcattcttaggtaaaaagcaacgggtaaacattgtgttaccacaatatctattagacagaattgacaatcgtgtctcacatagtaatttttatcgagatagaagccattttttagcagttgcttctcaacgtgaattaaccgctcaacaggtttaatggataggcgtagcaatacgcctaaaacttcaatctaatcaaccccgaaccaaataccgctccttccataaaatctcgagctgtgcgtagtcgtctgtcaaacgttctcggtgaaatatgcatctcaagacaaatattcttcttgtcttgcccctgtaaaaacaccgccattaacacctgataggcttctaagttcaaatcgtgtaacgtcatcacagcttcatctagcttaagataatgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaacttgccattcgttttacgctcatttgagccgtactctcacgaatattcactaattcgccttccaatcctgtgaccaaacaagaaccttctttcgttgcttctgcgtgagcagaaattaaaagaaccttccacgcttcaagcggtagccattcgccgttaaattgcacctgtttagcaatatcgccgcacattgcgtggaatttggcattttgctcaaggttgcgagtaataggcttcacttcaaccactaacggytttttctcatctatyggcaacgctttcacaaattcaagggcattgtttttaattttctcagtgcgtaaaaagtattttcgcttatgctccatacctaccaacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttctaaaatacccacctaccttcttaataaaatccaaactcatcttctccctctaacctgtttcaacaaaccaccccagaaagccctcaccttttcactattgactgctttcacttcttgaggtaatgccagctttggttctggtaaaacttcccccgtttttaaccgcttgctcattttgacgagggattttttaatctcatctttgagttgcttatcgctccattcaccagtccgacaacgcacatacaaatcggtaatcaagtaatactccgccgtagaaacaaacttaaacttctggatttcttccataccaaatgccataaacgcttgtaaccgcttgtaaagtttatcctcatcaggcaaacctaacgcttcgtagtccaccgttttgcaccactccacaaactcgcctacgcttggccagaatggatttttagattttttcgctcgctcaatcccgttttgcagttgctcaatcgtcgtaattttttcgttcaccaacgtttcaagccaaatccgctttgcttcacggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattaacagctctaatcgcaccgtcaggaattgccgttgcctttgctggcacttggtaatttggctcttgcccgacaaggcttttcaagttcattgatgccacgttttgcattaacttccccttaccgtgatagacataccttccgcccagttgccttcgtcatcagggataaacggcttggaagtattacgagcggacggattttgtggattttttgcagaaactccgtcattttgccaatcccaaccagcattgaacccacgccaaccacgctcaatcgaaatcgcaatagcttgttgaataggaattttggctttatccgcctcacgctgaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcttttgccagttgttcggtaatcccaaacttttccaacaaaatcaaatctgcggattttttctcgcgcgcgtttatacttcccgtcagggaagtattattgttagtattctctgaagtattctctgtattaacgaatggcggttttgcttcttcccgaatgtcgctttccgccattggggaatgttcattagtgacattgggtaatggcggttttgcttcttcccgaatgtcgtccattaatgcatcaaatttaactaaatccagtttgaaataaatgcggtgctctaagcgtttgtgagtttcaaccaatatgcctagctcaactaattttttgcgagccgtttcttgctcacggcgacttaatcccgtttcctgctcaagctcagcttgtgttttatatacgcctaatgggtttgaggtcttatcctgccaaaagaataattgcccaaataaaattgccgctgtcacaccgcctaacggttttgctaattgtggatagtacgcaataggctgtcccagttggcgtaatttttggctaaaactcataatcccaccaccttatcttgtgtaaatacgccattccaatttgctttcatcggtaattctcgctttgtgtaccactcatagagctttgcagctcctttcttgagtaaaacaggtttatatgccacaaacggatcttttccgtgttgcgaaatctccgtcgtttcttccgtcaaatactgatcacgagcgtacgacttcacacgtttatgattaccatcttgatagagccagtttttatccactaaaaacgccccaattttcaaagcgttcactccattcaagcctttgacaaactcaaacggtgaaatcccattacggaaataactttccattgaggcaatttgaagggatttttgctcactctcttcgattttatcggcgagttggcgtaatgcttctgaatagctagggagttgttgcacttgcttttgctctaactcttgccaacgatcaactaaacgagcagtaaattcaggagagaattgagccacaatcacataagtatcacgtttattaatatgatactcgtaatagacttgcccattttgctcatgggtgtacggactttccgcataccccccaattacccctttattcatcaggtttctaatagataagcacacatcacggtgtctgctttctgtgattcgtgcaatctcccgactactcatcgtcagggttgcattttctctctgattagtagataataactctgttttcataaacattatctccccattacccacgttccagcgtgggtttttattttcaatagcatgaacgcccttctctgcaaatagcttgagggcatccagttcactgtytgtcaaacgattyaaacctttctctgatacttccaattctaaaaaatcaaggtaagcacagaatttgtctaaatgttctgccttaaaasgacaaatcgttgatgcatctacaccaacatattctgccgcttgagcatctttcgtctatgatgccttctgtctgattaagtccgcawtcttcattgcagacttgcttaattcattgcgtgccattgcgtacctcatagggtaaattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccatcaaaacgagctacggctcaatgctctttaacaacacgaataacccacatcaccaaacaaggttggtcgcctgtaccagtggggctgaggcaaacaggaattgctattcatagcgacatttacagagaactggaacatctcacatcaatgcggatttatctacaacgaactgagatcggaaaggaaatgttagacaagtgtcgctatgaatgrcaacaaacagaggacacggcaatgactaaaatcattatcgaacgtaacccaacaagcaacaaatactgcgaaaaagcagaagttcgcacaacgggtaaagctggcagactrgcgagaatgttcgcaaaaaatcgcaaaaaacagaccgctaacaccctttcaagagtagatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccactgtaacaggtgggtgtttttttgaggtaaaaaaatgaatacatatgcaaagttctgcccaaacgtatttttagcaaaatgccaagagcagcacgaaaagaacgaaattattaccgtgacaagtaaatacggcaatgaaacagaggttgaaatacacaacctcgttaaacaacaagggggattttatttttactcttttgtgcgttgtgatgggttggatagtcaagctcgagccacagcgaaagcacaacgttatcaagaatatgctgataacgccgcaaaacgcagtaatcaatattgtgaggcggctaatgaggggcgtgactttttaagtcttgctgaaccaataaaaatcggacatcacagcgaaaaacgacacagagctttgattgaacgtaatgctaaaagaatggataaggctgttgaagaaatgaaaaaagccgaaagttatgccgataaaattgcatactgggaatccatggctgaaaaaattgatttatctatgcctgaaagtcttgagtatttcaaacataagctaaaagaggcagaagacaagcattcggacctaaagaaattccgtgaaaaacgagaacattcttattcattgacgtacgctaaaaaagccgtcaatgaatttaaagaaaaagtgcgattggctgaattgctttgggcttaacgaaaaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaatctaaatagtgcatctactgctcttacgcaaattggacaaaaaatggggacatcacagtatatgtcgccagaaattttaagtggcggtgattattcaatacaatctgatatttttgctatcggtgttgtaatggaagaattacagctagactctaaatatgataaaatcatgcaaaaatgtacagctagaaaacctaaagataggtatatgtcagtgcaagaaattattaatgatataaatcatttgatgggggaataattcaatgattaacttaattgctagtgcatcattctcttttccaaaagaacaaatacggcaaaatcaagatcatattctatcttgcactaaacacaataacggttacttatttgcagtggctgatggtgttggaggatacaaaggcggagaaattgcctccagaatcgcgatcaaaaacctagaactagcttacaataatgtattttccgctagtttggctgaaattaaaaaacttgacccagaatataaccaagcatctacaaccttaacatttggttatttaacacaagaaggattgtgcatagggcatattggtgactgtcgtctatatataaagcaaggtaataaacttcgccaaaaaacgaaagatcacacaactcatcaaaagttatttgatgaaaaaatctatacaaagaaagaattaaaagagctatcaggaaaaaatgtcatcaccacggcaatttctacacaagtcgaaatgaaaccagatgaattctttattccgatgtcagaaattaaggatgagaataatgaggtctccatctacattatgtcagacggtgctcatcatttttgggaacatcgcccacgcttctctgaaaaaacgatgaatagcattgtgaaattttcagcaaccttacaaaaaagaatagagaaatcacctattgatgattactctctcgttgctgttcaatttaaaatctcggaaacagagtaaatcccattgacaaaaaccgctacttcggattaagataaccgcactacacaacgaaagtcggttactcgctccgatacaaagcggttttttttgtacctaaaatttaggtagcgatcagttatggtcgggtcgagagagcctaataaaataccctcgtggaaataagttccgccgtctkaaatyggtagttgaagcccgatcacccactaagtgatcgactactaaactaaaatttcaggtacaaaattatgtcaaatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcgcaatgttcgcccgcaccaaagtcgccaaagattttcgcaaatgggtgctggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaacccacaacccaaccccaccgcactttccccgaaagcctgcggtggcttcctacacccaaaattcaacaaaaggaatgaaaaatgaacacacttattaaaaaattcaacctgaaatacctactcggtgccttgcttatcgcctttgtgacaggcggaagtttaactggctgtgaagagcctgagcctgtctctactctgcccgtagaaagcaattgccaagcagaaaagatttggacggaagatgacttcaaacaagctgaaatcgcccctgaagaggtaaattacaacgcattatccctacatcttccaccgcctgataacgttacaggtgaagatgtgaagctgattaaacaacataaccaaaaccaacttaacaaactgattgtaggagcaaaaagatgatcaaacttcaaattttacaaaacccaaataaaaaatacttcggtgaaatgtgggtggataaacatctagtgtttcaaggcataccaatgacatcggaaattattgctatccgaaatttaaacaaagccattgatagatataacagtcaaaaaggcttagtcggtaaaagagctatccctcactaccctgaaatcgaagggcataatccgattgtaattgagcaagctaaaaaagttgggctaaaagtaacaattatagaagcagagcaggttgagcaaatagcaccgacggaacaagttgagattgaaacagcaccaacagaacaagttgagccgaagccgaagccatcacagcccaaacgcaaaccatttaccccttacggcttaaaaggctatctggtagataaaaacggcaatgtccgcctaatgctagacagaagagccaacgccagcacgattgtacttgaaccgcagatgttcggagcattagcggaaatggtgaagaaaactcaggagcaacagaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgagggcgttttaataaagggcattacgcccctttctgcgattgcttaaacagctcaacggcttgaataatcaactgattttgtggaatatttaactctgtacttaactgctcaatttcagcaatcacaactaaaggaagtttgaaggctttgagtttaataccgtgtttttcctcactgcgtttaacaatttcggttcttgacawygccataataaatccttaayatyagttttgaagaacgagagagatttctccctctcgttaaattatcatcaaattagtaagctggcgagctaagtactaacaagatgataactaggataatgtatttaaacatttgattatcctcttcaaagttgggtagattaaaggtcagacccagctcgttttcagcattattactgaaaacaaagttattataagttagttatctaactaaatcaagcattatttcactaagccatcgtttttacggtggcttttttattgcaacattttcacgaaaaccaaccgcttgtagcaatacaggcggttttttattgcraggaaattaaaaatgacagaacaaactacacaaaagaaatacgaactactcaaagatgacacrgtagaacatttaggcagaacgctctatcgaattaaagcacttattacatttggtttagttggagcaggccaattaggcggttatatcgaaaccgaaaagaatttagatcatagcggtaatgcttgggtgtacgrtaatgctcgggtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggggactaggcagatgagctggttgatttcattaacgtgtttatgcttaattctcagcatcatcaacctgaaattaagtgtagtcaaacaaaaactagggaaaactctattttggatggcgctaatgaaagaataaagggcattacgcccctttctgattaaataactcaaccgcttgcacaatcacctgagtttgcgaaataccgtgttgctcggcaaggcgttcaataagctcaatcgtttcttgatgaagtttaaagcctttgagcttaaccccacgcttagcttcgcttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccccccaatcgcaatcccatcaatcttagcattaaggctctgacttagctccgaaacactacgattagcacttgcaatgctattctgcaaggtagaaataccactctctacacttcctaccctcgttgttaatatcgctctagcctgtgcttgtgcattatccccagcaatacgtgcttgacgttcttcagataaacctgataacgcattatcggctttagcggttgtagtggctattaattgggctttctcacggtcggcttgctctaatcggctcaccgcagtaccacgagcattggcttctgcttgaatcgcttgcgtgcgtcgattgacttcctgagctaacgcactttgtacggtgttagctttggataaggcattatcggctgtactgcttgctgtcgtaagctgattaataagcgcttggtctaattgactacttgcaagttttccttctaaatcaaccgcttgtactttagccgtgtatttgttgccgtcccaaacatacagtttgccgtcagcttcgttgtataactgtttatgaccaatgttttccgttgggttatcaatacgagcaacggttttagtcatctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacggttttagtcatctccaatttgcgtgcgggcattgcggtatcaaagacttcatcaataatattttgccccagcttttcattcaacaacgcaagctcggcatcaatatccgccccagtttcagcacttaaaccttgttgttgataccactctcccacgttaatgccacgagtgtgacgtaaccagtagtaacgtgtttgacgtggacctacattatgggtgtagatattcgctgtcactttcgcaatacgctcagcgttggctaggttgttggttgaacttgcccagatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttccgtttgcgtggcttcgtccacaaaatcccaagacagcgtaatacctgataaaccgcccgatacccacacatttttaggcgcaggtggattgtcaatcgtaaaggattgtactttttcactcagcatccgcccttgtgcatctcgtgcgataatcgtgacttggtattcaccatttgctaaatctgcaagattcagctcactactggattcatcacgtttaaacaggtacaacttcccgtcttttaagactttgatgtcatatttaaccgtgccattgcctgaggtcacttcccacgacactttcatatcaccgctcaacgtcggttgtacgcctaagtgtgttaattgtggctcaactttatggagcgtttcagacgcgggagcaaaaaccgccccttcatcaacaattcgctctttctgtggctcgtgctgtaatgcggtaatgccgtagctaccgtcttcattttccgccacgccaagcacacgatagcgttgtgtgctgactaacggggtatgcaacgcccaagtatccattacttgtaagcctgttggctcgctatctaatgtcacaagcgatttgttttgggcattaatttgcgaaattttacgacgaactaaccgctgtccgttgttatcattgactaaataacttaggtgcttttcgccctggacttcaatcggggcatcaagggtaacggttctgccgttaatggctaacacacgcccaccaagattgacattagcgtatgatttgtccgcaatttcgataatgtcacctggtaatacctgtaacccttcacgccctacgctaaagctgatcgtgcattgctctaagcgagacgtttcaagcacccacttaccataacggcgagcttgcccacgagaagtacaggcaaacgcaacgattttcttcacgttatagccataacgtttgatcatcgcatcatctgccacatactcaatcgctttttgatagttgttacgttcgtcggcatattccacttcaacggcggtaaaaatggacttaagcggtacatactggcgattaaatttaccgtcaatcacattcgcctgagtaaatgagcagacaggatcggcatttctgtcttgaatagcggttaattgcgtaccattccacaccacaatcgcacggaaaaccgacgccatatccgaaatcaccgaataagcatcacgttgctctgtcagccataaatttgccaccattctaggctcaacaccgccatagccatctggtacttgttgatcgcagtattgggcaatttgatacaactggaatttatcaatgccataatcgcctaaacgttgccctaagccagctagcttattggtaaccaaatcgtaaaacacccacgcaggattattggtccacgccagcttaaaatccccacgccataaaccactgccataggttctcgtatcaggatcgtaattgctcggcactttgaccaaacgaccatatagcagaaagttaatgtttggaaagctcgggttatagcgtgaatcggttttaatccccactatcgccatattgggatagctcaatttggcactaataatctccgtgtaactcgaccaaaatgtcgcattctgcaaacgttggcttttactgtcaggcgtaacacgttgtaccgtcaccgtgaatggacgtggtggtaaattgtcgattaaataactacggtgaaaacgtgatgaagatttaccgttaatcactacagtttgtcgggactgaccgttaatcaaaatctctagatgtaccgatgtgccgtgcgtatcgccttgatcgttttgactaaataacgcattcacgcctaaagtaattcgcaaaagatcaatatcagggtcgatcaccgtgcgagaaataggatgttctaatttcacttcagcacccactgacacttctctttctgacgcatcaaaatcttcaaggggttgctggtcttgatagcctaaacgatagcgaatcaaggtattttgataattccactcccctttcgagtttttaatcggggtgtaatcaaagaaggcactctgatactgatctgctgtcaccgcaccacgaataggacctagcgaaattaagccaatcgcacttaatcgctgtgctgattttaggttatcgggtgcttcgtaaggtgtatggccaccaccgccttttttaccgcccataatgtttctccaataaaaaagccgtcacagtttcctgtgcgactgtaatttgtttacgttgtcacatcatcaaaggtatcaataccctgcgaaatcaagataagacttgtcatcatttttccgtaaagtaacggaatcggtctgccttgaggggtaagattgcgaatgtttgaaaatgatgtgctttgctgcttttcgctatcacttaatttcgtgttcatatctggtggacgagcaagcatttgcatcgcccctcctaataaaagactagctcccatacttcccatcatcatcgcagtcatcccttgaaccattccaaaacccattgggccaagcataaaggcggtaccaattaaaagtgcacccgcaacaatactaaggacactcgatttccctgcccccaccaccacaggcgtaaaatgtacggtacaatcatcagcaagtgtcattgtaggattggtttttatctgctcttcgcttaaatagcgtttcccgattcggactttgtaatagcctttgcgtaaatgttggcttaagccttgaatctgactgagtagtccgctcatcagctctttaaaggaactgacttcaagcgctatcggttcgttaggctcaaatcgtttaagatcgccgtaaaatttaactctgaccatttcgggtatctccaaatactgtgcgtttgttgtagccaagcgccgtcataaggcacacgagcagataatcgcccttcgctgtggtgtaacatcatttgatgaccaaggtaaatgcctgcgtgattagccacatcgctaccaatttgcagtaacacaatatcgccaagctggggctgttcttcaaaatctaaccgctcaaagccaaagcggagcaagttttcttcatacaagttgcctgatttaaaccattcaaattcatactcaacatcatcgggcaaatccaatcccgacaacatataggcatcaagtaagatgttgcgacaatcttgcttgttattctcaaactgacgaccgacaagcggtgcgattgggcggaatttttgcaattttccgtcgcaaaccaaccaaaacggcagatttaaccgcacttggcattctctgtctgcggttgatagataaggcaaacctttctcggtgtctgaatcagggtgagaatgaacaaccgccacaatctcgcctacgctttccgcccgaatccaatcatcaggtgaaatttcaaaatgattaatcagatcgacagccacattttcacaaggaaaataacgtaacttaccrcccttagaaacgacaaaaccgcaactttcgtgcggttctgagcgtttggcgtgagcaatgattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattctaaatcaggtgtttccatttttactcccaataaaaaagcccgaacatatcgggcttatagattatttttcttgtaataatgtatccagttcctttaatttaattatcgcattttggcattcttttaattgttgtcttgcttgaaattgtgaaacatttgcatcaagtttataacaacttattacacgtttatcttttaatatttgaacatatcttgctaaggttttagctgagcgattttcaatactttttaatttttcaatcgcaaattgatgttcaccataactcttatccattaaatcaatcttgtgtttagagagaaattggttaagctcatgataaaagtaataataactatgtttgatgctatctctccattcaatttcgctagattgttttgacaaaatctcagctcgttcaattaattccgtatgcttaatcattatttatacgcctcacaataaagatacaagcaatctaaatctaggtgatttttttctgcaaattctgcgaataaatctgatagattagcgttacactcaactatcttttcaagatctgcgtcatctacatattgaacaaggttaacaatatgtaaccgctcatcaatttcacgaaactcagtaccaatgataaatctagaaacaatatgttgattaataagccgattgacttcaagaccgaaatctaacattaaacgtccactaccaaatactttatttaatttagtaataatgtcaatattatgttttatcttacatttatctagctcagttttgataggagttaaatcgtcataagcaaaaaagttcattagccgaccttctaatgttcgaagtatttttatgtcgccatttcgagctatctgaaatgcttgtcgataacaatctaaagctaattcaaattgattaaagatttcgtaagtaaaccctaaattatagatatttgatgcgctatgattgagttcaatagatttctgacaagcaaaaattgctttactttcttgattggctaaagcataaacacttccttccatgctccacgccaaatcgggtaatattaacttcaacttctcaatgtcgctaagtaatctattaataaacataggggtgaacttcttcatataacgagcatcctcaatgcgtcgaaatagactgtccgcaatagtttgtggttgaatggctgccataaaatcctcttctgtttataatatagttcaacacaatggcgaactcatatagtttacaagtaaaacaccttgatagcaatcaagccccatactgcgtcgtacttggaaagccwccraacggyaaaatggcgttagccccraatctcarcttgcaaccacgcaaacagtgagagcaagcatcttttttcggatcggttgtcgggttatcyttttcatcggcaacyggtccgcctgtatagccacactccgcagaacgatatggccaaatgcaagtatswgaygtaatcatcagcaacggwatrcgtgcattatctgtttctgckggyaaagccagctcaaakgtcgctacttcatcattkaggatttttagctgttcaataatgaacaaactcacactttcctgtgtcggatcggcttgtgagtttcgtccgttaggraaattkcgwgcatcaaggaattgrgcgtaaactaaacgacgtgtcactttcgccccaatcccttgcccgaaatctgcggctaatgcggtgacaatgccgtacaggtttgagattgttaaagtyggtcgrttactcggmccttgaccgctaatctcaaaaccgtccgcwtkaattggataggcttggtactcgttaccttgccaccaracattctgctgaccttgatttaagccattgtgaaagcgtaatagctccccttttcgtgtttggtcgctattactgctgatatgccttaaatcaatttcccacagttcaatcaaggcattttgttccagttttggcagttcgtttgccattttttggggtagggattttggcattaaatcacctcttcaaattcgcagttaatcaacgtatgggttttacctaccgtctgcgaccattttggacacactactttaatcagtggcgtttttggtcgctccctaaattgaaaggcacttacaccaccgtgacttgcaagaaattgcaacaatccaaccgcttgtgcgtgtcgtaggttaaaactcaatgaaaatttacgttgcaatggatttaatccatcaaccattcgctgttgatagccgtcaccaaatttatttacctttctgcgaggttcgctttcgacggtgtaatttggttgtgggcaaaagggaagtatttgtaatgtcatagatcaccttataataaaatacccttagaaactctctaagggtattatctatttaacgcaccaccactacgcagatcgcgtgtttgattgcgacgatagacaccatctgcaatctgctccattaacttcacggtaattgctaaatcttgaccgtcttttttggtttctacttcggcggatgtcggtttgccgttattaatcaccgtcacagtcacattttgcgatccgccaaaatgcgtaggcgtactcggcactctcggcacaccaacaccgccaccggtcgcaaaaccacgtttgccataattgagataattcaggtaatccaacccaagacgagaagttgcctctttggtgatgacatactcgccacggtggacgatacctgctggggtgtatttgccaccatcgcctgtgtagccgccactagagaaaccaacactacggatttgtccgactaatgccataccttgagacatcacgcctgctacagctgcaaacttagatgccgcatccatttttgaccaatctgccatcgcttgacttgcagcacgggtgacattgattgtcgcctccgcaatcgcaaaagatttttgcatcgcaaacattgctttgtaagcggcagattgtttgccccctgcctgttcaatcatcgaggttaaatccccaaaagctgaacctagtgtattcaagccgtccgcatatttctgcatttcggtttgaaatttatcattcgcataacgctcaataatttgctgtttgagtttttgaaattcttcttccttaagtaactgcgtctgatgaaatgcgtcaagccgtgcgagttcttgtgcttgtcgattgactatgtcttgatttggatcataaatcgcacgcatttggtcaagcggattgaccgcactttgagctttactttgtgcgtagtcaaatttcagctgatattcagcggtttgtgcttcgccattggtaagttgccccgcttttctgagttcttcaatcgctgatagctcattctttaaatttgataacagcaatttttctggcgcatatttccctgctaattccaaccgctctttggcaaaacgctccgttatagccaatttagccgtttcatattcggtatgtgataccacaccttttttcatatgctcttcaagacgctgaaacatctgctgttcttcaagatcgatttcagttagcgttgaactgctttttttgcgaagatcatcataaaatgacagccaattatcacgagcattttcgccaccacctttatgatttgtttttagattagtttgaattgtttttgtctgtgtttcatcgttgaacataccttcaaggacttgtttaccttgtagtattttattcaatgtttcaacagatattcccaccgctttatctgctgcatttgcggcggtgatagtacctgtggcgataccaattaacacttcattgtattttgcaccttccgttccaagaagttcgtacaaccctgctaaaacataagctgatttagcttgcccttgttgctcaagttttgcaacctctaatttttgagcgagagatactgatttttcttgtaactttttaaatgcgtcatctaaatctagagtggcattttcagcttggttacctgccttgtcgatttcatttagtgcagaaggtattctggctaaaatccattctgtgttacctgcatcaacacccaacgttttaaatttttgccgaacatcatcaatatttttaccgcttgttagcatagctttagcaagggcttctaattggttttctaatacggagaaatcaatattggcgttttcttttaaaatagaaatcttatcatttaactctgatatttcttttttagcactttcaggtacaggtaaacccacataattccaactatctttcaatgcaacaatgtctgtttgtaaccgttggatttgtttatcataattggcaagatcttggatttgttgtgtaattttgagcgagagtgctgcagcacttaaaccctcataactctcttttaaacgatgatttgcccctgcagtatcgagtgctttctgtctcgcactttctgcttgctgtgtaaaataccataaagcactgccggcaatcatagctgctccgacaggtccaccaagcaatgccattacactttgtaaaccttgagacgcttttccagctaaagtatttgctgtagcaagattacgtttcgctgtcgcctctgcttctgtgagagcaataatttgagcagcttgtactttcatttgttcacgcaaggtatagcgtgtttgctctgattgtgctaactgtaattgagccgcaagacttgccatttcaacttgtgcggctgttcgcatagccgttgcttttgcaagaatagattgagcttctttggtatgagctaatgtgttttttgcactattaatgcccgtttgtaaaagtgcggtcgaatatttgccaatttgcccaatcgcaagtgcagcggcaaaagtgcctgcaacagtaatcagatcttcgagattagtggcaacaaattcaacaccttcagccagtttttgtgttacaccaatagctgaatctgtttcaccgacaaacttaatcattgatgtttcaaggttagtaaatgacatcgaaagcgttttaacacgcttttcaaaatcaccatccacctgagattttgcatttttgagtgctttaatgacttttgatatggataattcgccgtttttacccatttcttttaacgcaccaacgctgacaccaagaccatccgcaatcgcttgtgcaagtccgggcgtctgttccattacagaatttagctcggcaccacgcaattcaccactcgccattgcttgcccgaactgcatcaatgccgcttctgccgacgcagaacttgcacctgacatagccactgcttttgatacggtttcggttaattctgccacttcggcttggctgatcttcaatgtatcggcatttttcgcaaagcgttgatacacttcagctgttgcacttacagcttgatttgttcgcaatgaaatatcaaaaacggtaccagttgcagctgccatttccgcttgaccatctgtaactaggcgtatgcggttttgtaattcggtgtaacgatccatcataacaaccgtttgtttggcaaaatcttgcaagcgccccaaattatcaagacggaaactccagtttgtcgttgaattaatattgttagccgctttttcaatattgtttaaatattgcgtggttcgctctgaaaactgccgtgcttttgcctgtgcccgagataaatttacctcaaattgcttggcaaatttctgggtctgttgttcagactttcccagccctttttgaaattgaatcgtttctaaatccaatcggatatacaagttaccaagagacgacatattttctccaataaaaaaagcccgcatattgcgagctttctatctatttaaattactacttaataataacgtatttaacgtcgttttctttttgcatttgttgctggatttctttttcccattttttattgaaaaaatacatcgcaactttgacaatacttaagaaaacgagatatgccaacacagcacccagtataatcttccaagttatgccggtaattattccgcctaaggtcaaaagaattaaagcgggaatgacaaagaataaaacaattactgaagtaaatgctctacctaaccacaggataagatcaatttcttttttaaacataccccctccttacttttctcttactgtacaaaattattgcatttaaagcaataaaaaatagtcacattttgactggtttaacagattatcggcttgctaaataagcctctacaccgtcatcatcgccacttttagtgacattttatttctcccataaaaaaagccacccttaaaggtggcttaaaatttccatttacttagtttatttattaatttgtttccattttctcttctcttctttggctaatagatagtcacaaaacttgatcaacccatttaataatccccaaagagagaaaataatcgcaacaccacttaacatacacaaaataaacataggtaaatcttgttcagctgcatttattgaaaaaatcaacatggaaatggcaaaacaagctactataaataacagaaacatcttaaataaagagcttattgtataatttaccgtgcgagcctctcccacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaaaccttgtaattctccttgtaatgggtgatctttatatttctccgccaaaggtaactgatgcattaaacaatacatcacttctatatattcagcactagacattaactcagaagcaatctttttaaaatctcttttataagcatttgttggagaaagttgtaacattatttactccgctaacattgctttatgaaacgcttccaaagattcatatacttcatttttacctgatttagcttcctgcattgccaacttagtttcaaggtttggttgataattcaaacttaacggaattgttttagtatatgcaatttcagtgagaagcatattaaacacttgtgatggagtcattccataactttttatcacttcaaaagccgtatttttaacttctgtgtttgttctaaaactgaaagcatcattaatggtcgccattttattgcccccctgtatttctatgtaatacatttattttaagttgaattacaacgaaatacaagggatttatctgttagccaaatacgccgccacaccgccgtcatcatcttccgcttcttctgccttttgataaaagggcataaaatccgataatttcgggctgtcgccttttggatctcggttgatcatcgctaataaatgcgatatttgagcggtgcggtaatcttcccgccaaagcccgaaaggttgttcttggtaaaataattcatactccgccaagtgtctttcgggcattgcttcaatttcaacaagggttttgcctaacgccagcgataaatttaactggaagcgtcggcggtcggtgagttttttgggtcacctaaaccattgttgaaatcaattaagacttggttatctaattttgcaatggcattcaaatcatcgacattaaacgggtcaaacagcaattcaccattctcatcacataggcgtacagcaatcgactgcggtaaacggtattttgcaccgaactcacttagagctgtcgcaaagttctcatcctcttccgcaggcaattcatagccttcgagctcagcttgctttttcagccatacgttgatgccgtaaagatggttgttcatatccccaacggttaaatcacgcacatagtaggtcgtgcctttaatctcaatcgggttcaatttgggggtttgggataatagggtttcacgtaaagtcataaggtttccttttattgaaataaaaaaccgcctgtattactacaagcggtcagttatcgccaattttttacaactatcctgttagtggcaaatgataatcgcgtttggtatgcttaatggttgcaccgctttcaaacttacctttcacttcgcctgagtagttgttaccagattgaacaaagccagtgccgtacattgtgccttgattgttggtgaaaatcagtttgtacggaaagctttctttggcaaaaaacttcttacgcaaaagtgattgcattgccgttgaaggtttcgcatagaacgttaatttggttgaaccaaattcaatttcaccaggttcagtaaccgtcccttcatcgcacattgtggtaacatcttcttccgttaaggtatcttctgaacgttcaatgtttttgatcgcacagaaattatctgaccactttactcgagcgactttagcttgtttaaagtctgtcggttgatcttgagcagtccaatctacctcatcagctaaggtgataaccccaggtgagccgttatcgacggatttaatcggataagtgccgtctaaacttcctaaacccgtgatcgtaatcgcatcaccagccttgaaaccgtttgaggcaacagtgatagtcgcgttcggtttaacgttacacgctgtgatattcttttgctcttcgacacctgtgccaatataaaacttcgtgccttggaatttggtggtttttcccgccataattacactccttctcgttgatattcaatgttaaaaataaggtttgcaacgtaccaagtccgctgttgctggtcttgttcgtagctgtattgagatagctcaaggttgtcgatatgttcaaaccctgtgcctgattgtgtggtttgcatcacctcggcaatttgttgggcgatctcatctagttcactttcgccattgtcgatagactttatataaatggcgatattgagctgtgcttgccactgctcatcgcaatttgtaatgccgtcgcagtaagcctcatctaaaaagacggctatcgctttttgctcttcgtcaatgtcaataaacgttggtctgccgttgtagtaatgttctacatcgctaatctgttgctccaacaattcgacgacttcagagcggatttgagtgtggatacgcattattttctcctaaagacaaaggtcagttggttgatcagctcttgtttcacttgctcaggatattgagacaactcctgattaaacgcttcagtaagcggtgtagataacgggactttcgctacatcaataccgtagcgttgtttaccttggcgaaacataatatgcgtacgtccgttttttaaggtttgtttaaaacctctagcaacagaatgacgaccaacacgcaacacacccaggcttgcaacaatccgattacgtttcccttccaatacccgaattaatggcaaatgagtgcggtttactcggataatggcttggggattttgtttggtcggatctttggtcattttggcacgcccacgcaccgtcttgacgggtacgccaatctgttgagccacagactttgtggcttttcgcattgcttgcttacccactgttttaattgctttcgctgttgcagtcggtattttttgtctgacaagctgttgaatatttgcctcaagttcttttaatcccgttattttgacacccatcgcttactccaactgtaatacaatcatctgatcgacatagtgataagatttgacgaggtattttttctcgccttgtaccaccttatgatctaaccgtggtttatagcctgatgagcgaaatagcgtgagtgtgcgtaatgtgccgtttaaggcttgttggtccaccgaaacgtgaagcccctccataatatgaggggcttcgtcataggtagctggatatggcttgccgttaatcagccactccgacatcattacacgctcaatcacgctgtccgctttggcgaaggcttgttcaaacaaactaggcattgagtttcaccgtcactactgccgttgaactcggcgagtctgaccacgcaataccgatatatttatgtgagcctgctgttttggtggcttcttttgcagaagtgtcccagtaaagcttgtcaccttgagcaatcgcttcatcgctttttgctttcacttgccataccccgatcacagacaatgccccgatctcatctttcgcaatatctgcaacagcaatgccagctaaatcacctgtcacgactaattcaccgcctttgattgcggtttttgctttaattttgatggcttcgcccatctcgataaaatttgttgccataaaaagctcctacaaagtttaaaattgattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaattgaatttgccctacaagttgttggttaagccgttgcttttagtaagccacgataatcaatgacattgacacctgcatcaatacgcactttggttgcaataccgtcggtgttaaagccttccatttggtcaatgaatggtgtttctacgccgtcaaggtaggatacttcgatcgcttctttattaatgagataccaatctgtcgcgctgaccgcttgtaagcgttgtgatttcgcaatcggtacaatgttttgcaatggattgataatgcctgagtttgcctctgcaccttcaacagagcttgagcctaagatttgttttgctctggtatgaagtgctgttggaacaagcaagtaatccggttcaatcaatagctgagttttaccgtcaaaagatttgtgagcgttcatcatttggatcgctttgtctaacgtatttaaaccaaatgcactattatccagtaagttaccgcgagtcttatcaaacaacgctttaccgtccgctaacttaccattgcccgtaatggtcgcaaaaatcaaattagcaatggttgcttttgctgcttgacctaatttgtatgggattttggtgagcattcccatatcgtcattgataatcgcctgacgagtaatgctgaacgctttaccataagtcgctaacgcaatttgggtttgcgtgtcggttaaagtagcgtaggtgtattctgctccttcaggtaataaatcaagctgatcgaagctacccattcccacacgatgagcagggcggaagtcggttaatgtgccttttgttgtgaacttgtcgaaatcttcaatgtgttcttgccagcctttaataatcgatttatgtgcgacatctaacaaaattgagccgaagtcgctacttgaatgagtaaaggcttgtccgacaatttgcattgcgttcataccacttaatccaacgccacgatctaccaaagacgcacgagccatttcacgtaaggtcattcctgcgtatggattgtctttttccgctttctcaccgccaccacgatgaattaacgccgctttcatactgtcaccgacgatattaccgtttgaaacgtgaatatgagtagtagcaagcggttgagtgtctttacctaattcagccaacaaacgatctttagcttgttcagcactcattgttaagtcacctaaacactctgccattaatccatcaaaacgcccgccaaagttagcaaatgttgctttaattttggcattgcgttctgcaagtgtcgctaacggatcggcttgtggaatttgtgcttttggttgctccgcctgtgcttttggctcttctttggtaagagctggctcagaaactaccgcttgcggttctactgttgtttttgcttgggcttttggctcaagtaaggtttttaatgcatttggcatagatttgaactccttcattcgttgagaggtaattgatgccattgccttaataggctcggcgagtttgtctgcgaaaccttgctccacacactcttcggctgtgagccacgtttcttcttttagcatttctgctaattcttcaggggatttccccgttttttccgcatacgcaggaataagggtattttcgattttgtcgagaagatcggcatatttacgcatatcttccgcatcaccgccttgaataccccaaggtttgtgaatcatcatcattgcatttttaggcataatcactggatcgcctaacattgcaataactgaagccatagaagcagcaagaccgtcaatatagacggtcttgctggctgggtgattttttaataggttgtaaatggcgatgccgtcaaacacactcccccctggggaatgaatatgtaaatcaatgtgcttgaggtcacctagatttttgagatctttcgcaaattgttgtgcggaaatcccccaaccgccgatttcgtccataatggaaatctcggctttctcttttgatttggctttgattgagtaccaattcatttttttcctccaataaaaaacccgactatttatcgtcgggttcttctgtcttttccgttacaacattttcagtgtgaacttgtgtattcgttaaatcagtgtcgaacttaagaccatatttgcggttttcttccacttccacaattcgtcggcgtttcacttcagcaggattattaccactggctcggattgcttcgctttcagtagatatcccaccaacaattcgacgtcgccacgcttccgtttctttcacaggatcaatccacggcatcacagggcctgaatacacggcgttataaacactgtttggatcaatatcagggctgatttcaatttcccctgatgctatcgccattctgagccattctcggtaaatcgggcgtgatatactggcaacgaaatgatcttgcagtaccgcatagccttcaaaactttctactagctcttgacgttggcttgagtaagtgccgttgtagtctcttgcaatactagaatagcttgagcgtgtacctgcagccgtagcccgaagttgcccattgcgaaaactctctaagttagtgtttggacgattagaattaatcagcccaatatcttctcctggttttaagtcgtccacgacttgtcctggtgcaatgtcaaaataacgattttctttactgacatcatcaggatcgaacaacgcagggtcgccttttttgatgtacatcgttaaggcagcagcaattcgtgcggcgacacgttcgctttcttcataatctttcaaatcagcaaggcgaacaatgacaccgtgaaaaagtgaaacaccccgtaattgatgtatccgtttcactaatgcaagatgaagcatattttccgcaggaacggttttcactcgcccgtaagtgcggttatcttcttgtggattataaaaatagacttgataacccgttggttttcgccacgcattgagataaatcccttgtactaaattctgatcttgttcattgctattcatcgggacaaaatcaggttctaaggcttctaaagaaaaaggaatagacgtagcgtgtgttaagccagacaccttacctaacacaaggtgaacaaaaacttcaccatctcgcaaccaagtccgtagtaacattcgctcaagttgtggacgagtgaaacgccctgtcacttcaggtcttatagaccattctgcccatttgcgacgaatatcatttgctagggcttcattcacattgccagctaaatcaaggggctgtggttcaacataaatacctttcgaaccaattacacgttcttccagtttatccaaaatgccgatcacaatatcgtgattttggtctaatgctcttgcttgctcacgcagactgaccgcactttgtctaactgcagtatttgcaccttgattttctcgaatggctttatgcaatcgactgggtttcgctgcttcatacgcattaagtaccagtcggtgttttgctctttctgctgcccatttgggtgagattttagcaatggttttttcaaataaattcatttaaaacctcgccaatttaaaacgtccgccagcattttgatgtgcttgttggcgttgtactttgcttaaacgttcttcccaatactcccgacctttacggatttccgcaaggttttcacgggtgacattacgtccattaaaggtgatacttttcccctctaacaccgctaattcggcttcgacgtatttgtcgatcatctgttggatttggtctaatcgcatttttcacctatttatgtttataaccagccaccacttttcctttctccaccatttaaccaacgttgctgtgtcgtcgattttggcttttcaggcagcggtgttgatttttcttcaacgctgaccgcttgtgcctgttcgttgtgtggggcttcaaggttaataatatttggatttagttcaggcaatcttgcccattcgggtatgttgcgttcatctccccatttgatccgctcgtaaccgcgtaaaatcgcaatagcgtgagcataacaaaataagtctaaggcttcgttattgcctttacctggtttgaaccatttgccgtctgccccacgctcttcataaactaattcatcaaaaaaccattgcccgatccagtctgggaagtgaatgtaattcgaaccttgactggttttcgcaagtgcattgctgatacggtctttgagttggtctgtttggagtaaatataggggaacatctcctcgagctgatgagtgtcggtcgcttcgtgtagtgttgtcaggataactttttgtgatcagcttttgccgtttggtgctgtcgcccttaaccaaatagaccctttttgctaatccatctctgcgacattttcgccaaaatttataagcattgtcagttacgccatcttcaccaccactatccaccgccattgctaaaatcggcattaggcggttgtcgtgagttgataatggatactgtttttcgagtacgtcgctgattagaatatgccaatcatcaggtaaacgtggatcgattttttcaacaacgccgtcttcatcaggtaaggtgtgcgagatgttgtagcggtcaatcagccagcgttcgccattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgttcgccattttcaccataaccgacaatttgcaccacaaagcgacggtttcgtccgccttgtacatccaccgcagcaattaagaagcgacactgtggtggtacggttttctctttgagttcttctctgcgttccatgagctcatctgctcggcgttgttccaacgcagaacgggggaaatagggcaatccccagtcagtgttgataaccgcttttaaggtttcttcgctacctgttaaatcatattcttgttccgcagtaagtagtttataagttagctgtgcccacgtttgataagcagccgcaggaccttctaaccaaaaggaagcaatgcgtgatttgcgtccttctcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatctgaccgcttgtgtcaattttttgcccttctttaagccatacaccattgatattcagctctcgtttcatttcgggcggaattttatgtaagcagtggggacattgtagtcgtgccttttcacttgcagtcacaaaatcaggttcgtccctgaaatccaccatatttgccattgatggttcgaaatattccgaacattcggggcattgccagtagaaccgtctgcggtcgcctcggttgtataagctcaaaatccctgttgttggtggtgcttcgtggctacttttcggaacgtgtttaatatcaacaatatctttaccaggagagctttcaaccagtgtcattccggcagacataaaggtggttgtacgcttagacgctagggaaaaaccgtccccttcgccgtcaatatcatcgggccagcggtcgtaatcggttagtgcaacatatttgtagtcagaagatgacagtacgttaattgacggccaaccgattttgagcaagttgcccgctctgaaatatttgtcgtggacgttgttgtcatttttacgggggctgagccgtttggctatttcaggcgaacagcggaaagtgcggtctaatcttttgcgactgtgttcgctggctttttcttgagtgagttgcaccagtaagaagtcggaagggtcgcaaatgatagaatatgtgatccagccgtcaattaaacctatggttttccctgttcgagcaggtccgacaaagacaacagcgtcatattctcgggagtttaggcagttcattggttcaagcatataagcggctgtatttttatcccacttgaccgagtttcccccaccaaccggcactcgcatatattctgcaacagcttctgatactttcattcggcgtggtgctttaatggcatttgctatatcacagcggatttcttttgcactggcaaacattattcatcctcgctcgtttgttgaatgtgtagtgccatttgatctcgaatgtcatcaatcacttgttgtactcgaatgagatctttaggttgtaacccacaatctcgctctaaaatatcggggagagtttcaagagtttggactacggctttggctaaaatactcatttcttgcgatacttcaaaagctggaattagctctcgagtttctcgttcatacttcaagcgttcgttttcagcttgccaaaaagcacggcgatcgttaggacttaaactatcaacatctgccgacatcttctcggttaaaccagtcaaaatgagatcgcgtaaggaatagagttttagcttgctattactgcccaaagatggcgttaatccagcaactcgttgagatactgtctgcctatgtaatcccgtgacttcggcgatctgatttatatttaattttagttcgtgtaaattttccatttcgctaaaaccttcaaaccgcttaaaacaaaaaattgcacccaaagtgcgaaattaaaatgaaagatgatgatgcctagaacctcaaaaaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttacatcacttgcgtattttctcggggatttatctaacaaccccaaaaccatacgcaaattatgtagcatttgatttacataaaataaaagagcgatcayctgaccgctctytatcgtgrcacaaacrttaatcagctatttaaacccttgcttagttcgtgcttgccaytctctratrckwtcaayctgacccgcacayaagtcacgttctcccatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgtgcaaccgcttaagctcatcgacaacaggacgaggcaaagcagtaacgcyacacggctctttctgtaaaatagctttaatctgttcattactctgctcyacctgctttcgtagtttatttgcaatrytttgctgatattcmaccgcttgtcgctcttgttgcagttgcattgtcagcttatkgtttgcttyttgctgttgctcaatagtttgggcytgcgtctggttctcggctgtcaagctatctatcctcygtgactgaccccatagccacgcacacaagcccaaaatcaatgccattaagattttattaacccagctaaacataacgccttctctttctcacgacggatttctaaccctcgtaacttcttgccacctgaataaacccacttaggcaactcattacaggcaccaacataatcgcctgatttgattttacgaaagaacgtmgatttactcacggtgccacacccagcattaaacrycagcgaagtagcaacatcaaacaccgattgcggaatatcaccaccatttgcgtaacggttcacgcatttttcygcrtkytkaatatcraccaaccamcgytctgcaatctctttgtccgtgtaaacttttctttcaatcttaccgcttgacgcttccgttgaaccaatrccaacrgtaagcacatttgcaggacacaaataaggctcwcgtttacaaccttcygcatcgcckataatctcaagcccttgctkacttgtacgaaattgaccgtgaaaatctgtattcaacaccgcaataatggcactsacarmacaaaccccaccgmcaactttaccyagtkttyttagcttgctcattacttaacytctctgcccttacccgataaatctgcattctgatttgatgagcttcttcggctcgctcacgttcacgacgcttcgccttaccttcgtcacagcgttgatacaagttcgcacacgccgtcacaataccaatcgcaagacttaaaatcattaarttctgttgctcactcaaccacgcaataatcccactaaatccagaccaaatatacgtctgtgttcccatatctctcataacatttttcataccttagccctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggctttcaccgctcaactaaaaataggaactaagacgatgaaaacctatcaaatcatcatcttcttaattctgattgtgttaagctcatcagcttactaatcagataaagtcctagcggtggttgcccccactgctaggcagttcctaaactatacaaccaacgttttaaaaaatcaagtaggtgactatggcaaattcaatgactgaacattctcgtaaacttcgttctaaaactgcgaacgaatataacaaactgtgcgtatggaaacgcctgttgcggacgaatttgtggcaatacttgctgaaatcggcggtaagaaagccgaagccattaaaaaactttgtgaaatttatcggcaacatcaggcgtagcaatacgcctaaaacttcartctaatcaaycccgaaccaaataccgccccttccataaaatctcttgcggtacgcaaacggttgtcataggttctcggtgagatctgcatttcaagacaaatattcttcttatcctgctcttgtaaaaacactgccattagcacctgataggcttccaaattcaaatcgtgtaatgtcatcacagcttcatctagcttaagatactgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaactccttaatcttcgccytatacgtttkaataatttccttacaatcctcaaccgaccacttcacaggagggtgatagctttccaatgcttctactcgctctgccccgattttacgyacaaggttgatrcgrtattctgtgatatttccgctcaaatgattgttacaagcactrcattgtttatgracrttgtcytcrttaaatctcagctctggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgaaatacaaggctcatctttatctcgtaaacgaatgtattcattaaaaacagcctgagcgtctttaagccattcagaacgagattttaagcgttctctcgttgctttaatctttgccctttcttctcgatttcgcttttctatggctttytgacgtgctttctcttgggctattttggcaagtttcacaccacattcagcactacaccattttctaaagctatccgcagacttaaactcaccaccacagcatttgcatttacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagacagaaattcgggttacagaacgaaatggcgaagactatatcagcctaacagatatgtgcaaagcctttggtgatggtgatcaactgataaaaaactggctacaaaacaaaaacaccattgaatttttgcaagtttgggaagagattaacaacccaaattttaatttggtggaattacaccaaattaaaaataatatcggcttaaaccgctttgtaatgtctgtcaaaaagtggtcagcaacaaatgctatcggcttaatcgctaaaacggggcgttatggcagcggtacttatgctcataaggatattgcccttgaatttggctcttggctcagcccagagtttaaactctatctcatcaaagagttccaacgtctcaaacaaaaagaagcccaagaaaataaaacggaatggaatgttaaacgtattctaagcaaagctaattaccgcattcataccgatgctattcaagcacatcttattcccagattactgaacagcacacaaccaatatttgtgtattctgcggaagccgatattctaaaccaagctatgttcggtttaaccgccaaacaatggcgtgagcaaaatccgacattaaaaggcaacattcgagattatgccagcgttgagcaacttacggtattagccgctctagaaagccaaaatgcactactcatagagcaaggtgtctcacaaaaagagcgacttactattttaaaccgcctggccattcaacaaatgcaatccttattaaaatcaaaatcacttgaaccattaaaagataagccgttgttgattgaagatagagaatagttgagcataggagttatttgtaacggatccaccgtaatttgttataaagtaaaacttgacttttaaaaataaagccttatattagtcgtcagaagcagaggattgcaagattctttgttgctgattccggggcccagtctttatgattgggcttccgtgtatttaagttatggaaagtatatgcatccctctcgaacttatattgtttatcttgatgaatttggtcacgttggtccttatgtttccgtagatcacccaacacataaaactcaccctgtttttggattgggtgggttcgtcttgcctattgaagaggttcgtccattctcttctttctttttcaatcttaagcaatacttgtttgaaaattatgatattcctcaagcaagaaaagaagccaaagaacaaggtcaagtatttaaactttcgacgtgggaaaagaaaggatccaagcagtactctgtagcaaatctacaaaggtatacaattcacatcacacgctctaccaatcgcattataaatcaaataaccgaacgtggaggtttcctattttatgttggtgaagccaagcaaaaagatgtagataaacacgatgctcaacgggtttatttatctagtttaaaagagattatcaaacgactagatgatgaatttaaaaaccaagaagatcaatttctgatctttatggatgatagtgaatcaagtgcaagtattgtaaaaaatgcaatctatgaaatgcatcaaaatagcaaatttcagctaatcgaagcaccagtacaagtagacagtaagttatatcaaacaattcaatgtgctgattggctatgcgctatttatggtaaactttcattttatgaaatagagccagagtccaaacctgactacgaaattttcaagcgttattttggtgatcgcattgctaaagcgcaaaaacgcagtaatgtgagaaacaatttaccaaaaaaagcctctgaaaaatcactcaaaaagctttgtgacaaatttaataaccacaactgaccgcccaccgtggcggttttcttttatctaagtatgaaccgcttgttttacttcaaaggtaagatttaaagcacgcatgactttaagcaccgtagaaaatgtcggattacctttacccgaaaaagccttatataacccctcacggcttacaccagcttctcttgcgatctgactcatattacgagccttcgcaatatcgcctaaagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcggataaaatcaaatctacatcatcttcttttagcacctcatttaagtaaagctgaatttcctcttcacttcttaaatgttccgccatatcaaaatcttgtagttctaccatattaaactcctaattctttgctagaatatattccaaataacttagtgaaaatacaatctatgccattatacgaaaatgcaaaagcacttattagacaaaatctaaccgaaataagccaaggaaagaaagcgaaattacaagtaataggctcattcacagataaacaatttcttgatataaatcaacatagaaaaaaggcagaattgccaccacttgaatgtaatgaaattgtctatattggtcgccatcattatcaaagccgaagcaaagacggttacaatattaacgatatggtaaagcaagcagaaagcgcattatccgttcattcttgccttgtaccatcaaaccgagctaccgccctagaaaacccacaccaacgtcacgatggctacggtaatttagtgaatgatcgtgctattttagagttaacatcaaagaaaccccgtgctgagttgttttctgtcattcctaaaggcgacagcataaaacccaatgatgaccaataaacaaaaaccccgaactcatcagctcggggtttatattaagtggtcttgggtaacttagatttccaacgcccccacttaataaaatcgaccttgggtaacttagatttccaacgccttcgatttgtttaaattataaatctaacaattcattgcgtcaaatttttccgaaatattcctttattctcactaatttttccccctttctcatatctcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggatcgcagtcctgaaagaanaagtggcggtaataatgatagtcgccaaaagcgactttttttatagccaaaatctagtcagattaaaggtacttgcaaattgcaagacccttaaaacttcaaaagggtgttccaaattgacactccctttgaaaagttgtcaatgatggactaggtaagggggcgaaagcccgctggaagtttaaccgcttattcaccagtactgcgaaccttgcctagttcatcaccagtaatcgcagttgctcgtgatgattgaattaaatttcaattagagaataagcgtatgacaactttaacatttcaaaacaccgcaatgacggtgatcagccaaaaaaaataaaactttctttacatcatttgatcttggaaaggcattaggctataaaaatccatcagcggatattccaaacctttacaaccgcaacgcagacgaatttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaaaagatggaaaatacaacaaaaatgttatttgacaaaaaatctgtcgctacactgcttgatgtcagtgtaccaacaattaacagaagaatgaaaaatgacaaacatttcccaaagccacttctgatcggaggtaaaaatttttggtctaatgaacaaataaaccactatattgatacaattcagagtgaatgcacctcaactgcataaccctttcccctcagctgcttgctcaacaaaattcccccaccattgcatatattcagctcgttgagttaagtattttgctttattgtatgtacctcgtacactggagtattcaaaatgagccaagcacacctcaataatttcggaattaaactcagcctcattcattgctgtgctaaataccgatcttagtccgtgagcagtcaatacattgcgataacccattctttgcagtgccttattaggcgtttctttactaattggctggtgcggatttttacgactagggaaaacaaaacgactgtgatagcgatttaatttttgtaaaagctgtaaaattttaatcgtttgagtagatagcggaagcacaaaatcctgaactttcccttgtcgccccttcattttctcttttggaatatccaaaatcttttcctcaaaattcacttcagaccattcaagttgtgtaatagctcctgctctccctgctgttaagatcaacaattctaatgcacaacgagtttcaatttctagcgtactattttgtaaatcttcaaacagtttgcctaataattcaggacgaatagtaggattattttctacgacgggtttcaaaaaaacctttccaatgtctgctgttgggttatatttaatagcccctcgatttactgcataaatcataatctggtttaaatacccgatcatacgatgcaaagtatctagcttcctttctcgttctaatggttttagtttttcaatcgcaattggtgctgagatgtccgcaataggatagtgaccaagcaatttcaacaaatgccgatttagtcgcttttcaatatcgttgtaggtcacaacctttaacctgcccgtatctacctcatttttttcaataccaaccactcagtagccatcgaggatagagtgagaacttggctttctaaagccgctttttcttgctataggcgataatctaacggatcgacattttttgccaataaagagcgataaagatcacgaatttcacgagcttctttgagtgaaactgacggaaaagcccctaaactaattaatgttcgtttcttggtaaaaggtttataatattggaaacgccaaattttagcccctgtagctctaacaagtaggaacaaacctaaaccgtcagaaagtgaatattctttctctttaggctttgcattattacattcagtaacgcttaaaggcttaactgtaactgccatatatatctcatttggtattaccaaaatcattttggtattaagaaaaatgcgtcatttttcttaattttggtattacataatgaaaaaatactaaaacataataccagatataataccaaaattgtgatataggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataggatgatatagtttgatatggattgatacagcagaaatgtaaaaagccttgttttacaaggcttttatatatcatttgatatagattgatacgaaatgatttagaaatatggtgcgactagctggactcgaaccagtgacccccaccatgtcaaggtggtgctctaaccaactgagctatagtcgcataaaaacgaggtgtattctaaagaaaaagcgaaaacaacgcaatagtgtaggaaaccaaccgcttgtttttaatccaaatttaagcgtttttgtgtaaaaatatgtttatcttcccaacgtaacatcgtcaaatgattaccccaaacacagcctgtatccaacgcataaatcgtatctggagtttgataaccaattaaactcgcccaatgcccaaaaataatcggttgctggcgataaaacggattatctagttcaaaccaaggttttaagccctctggggcttcttcgactggtaatttacaatcaaaatccaaccgcttatccgcataacaaaaacgcatacgcgtaaacacatttaatgcataacgccaacgctcaatgccttgcaaatccgcacgccactggtctggtgaattgccatacatctgagcaagaaaatctgcaaattgctcaccttgtaacaccgcttccacttcccttgcacaagctaaagtggtcgctaaatcccattctgggcttactcctgcgtggactaacaaaaattgatgaacagggtgttgtgccacaagcggtcgagagcgtaaccaattttgcaattccaaacgatcttccgcctcaaaaatcgcatcaaccttatctttaggcttcaccgctttaattccctgcagtgtcgaaagtaaatgcacatcgtgattacccaacaccacagttgccctctcccccaaagccttcacataacgcaaacaagccaaagagttctcgccacgagcaaccaaatcacccgttagccaaagttcatcatactgcggatcaaaattagcttgctcaagcaacaactgaaattcatcaaaacagccgtgcaaatctcccacgatataggtcgccatcgttcttccctactctacgctctgcaaaatacgatctgcaaatttcccgatactcaccgcaaaattattcgacttattccaatctaaaatcgtacggaaattattcgacaccaagaacgctcgccctacctctttatcaggacgaaccaaccacaacttctctgaactcaacgcattcagttttgttgtttcttgagccgttggataggctaaataaacaccccacgcctgccactcagcaaggctttttgctttattcaactcaatcccagaaaaagagagatcgataggttgagccaacttaacctctaccccccacggcaagtccttatcccagccaacagttgccagataattcgcaatagaagcaaaggcatcatactgatttttccaaatatccttacgcccatcgttatcgccatctgccgcatagttcaaataagaggttggcataaactgcgtctgccccattgccccagcccacgagcctttcatctcggcacgcactaaggttccctgttgcaacatcttcattgcattgacaaattcttgagtaaacaacttctctcggcgaccatcaaatgccagtgtcgccaacacagacaacacatcaaaattgccctgataacgcccgaagctactttccataccccataacgccatcaaatactctttttgcaccccatatttctggcttgctttggttaattgaggctgatattgccaccaacgttgtgccgccacgtccacttttgcttgggttaaggtcttattcaaataattcgtcaccccatttggatttggcggtggcggaggtaaattaggatcacgtcgacgactagcttgttgctgatctaactcaacggcacgaggcacatattgaatattcaacgccgtatttagcacctcagcggaaaccccctcattcgccgcttttttctttaaaaaactcacataatcatcaaaatgaattaaagaacgagtattagggtacttagcctctaacgccaccttaggatactcttgctcagaattagcacaccctgccaacaccaagcacgccattgatatggttaaataggatttcattatcatcttactttatctattgaccattctacttggtctaatcacattatccgcagtaatttcagcaatacctaaaaacaacttttctgctgaaaacaaacgcacctgtccataaatcccctgcggattatcaaatttcacacgctgcccaaaacccactgcttttgtctgttcatcagttaaatccaagctaggcaaacgagccactgcactatccatcggcaacagtagctgatctaactcaacaagcggctgattttccgctaaattttgcaaggcttccaagctcatcatcttctcaacaggataatcagcaaccgccaaacgacgcaacatcgtaacgtgagcgccacaacccaacgcctcacccagatcatcaactaacgtccgaatataagttcccttagaacaatgcacttccaatgtcaaataaggtgcttgatactcaacaaataacagctcaaaaatcgtaatcgggcgagcctcacgctccacagtaataccagctcgagcatattcatataacggcttaccattatgttttaaggcagaaaacatcgtcggcacttgcaaaatgtcaccacgaaatgcctcaagtgccgccaaaatatctacaatttcgaccttcacttcacgcgtctgcaccacttgcccatcagcatcagaagtatccgtccgctcccccaattttgcgatcacccgataacgcttatccgcctctaacaaaaactgagaaaacttagtcgcttcacctagacaaatcggcaacatacccgtagcaagcggatctaacgctcccgtatgccctgctttattcgcattaaacaggcgttttaccttttgcataatatcgttagagcttacaccctgcgacttatccaacaaaaamacmccgtggacatcacgcccttttttctttggtctgcccatcgttactcttcttcaacgtgacgctcttggtctttacggatcacatttgtcaccaagtttgacatacgcatcccytcgaccaacgactgatcgtacacaaaacgcaattcaggcacgatacgcaaacgcatcgccttacccactaaggtacgaatatagcccgaagccttatttagcccctctaacccacgttctaccgcactttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcactatcaaacaagaaagtcacaaacactttggcataggctaaatcacggctgatttccacatctgatactgttaccatgccaatacgtgggtctttcacttcacgttgtaaaataattgcgatctctttttgtagctcttgtgctacacgatctgatcttgaaaattctcttgccattgttttttctcttaaataaataatggggcgtaagatacgcccctaaattgtctgtcttattgcttgtaacagcaatgtaattgcctgtgataatagtccaaaaaggcttatttcacaagcaaatgatatacaagcggctacttttgcctgattttttgcaaaaagtgactaaaactgatacttcattcctacactcacgttttgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacactcacgttttgccatttttccccacctttttggcgagcaatcgcatattccccgaaaagatgaagagctttgctaatttgataattcaatcccaacttcgccatagtggcatattttgcaggtgaaataccctgtaattcaatttcactttccgcaccgatatagcgagcattaaagccaaacgcattttctgcttttggtgtcatacggtgagataaggtcgtatttaagcgtaaatctccccatttcattgtggctcgtaaccctagcaaataactatttaagttatattgagtacgatttgcttgaataccaaaatttttcccttcgtcaaaggctttttgataaacagaatcaaattggtatccgataaacggacttatttcaccttgttcaaatttaatacgatgtcctaattccgtatagaaatgataaagctttgatttaacctctgtttcgacacggcgtgtttcatttcgcattaaaattgaacgcttaatcttgtttttcgcatttgccattccaagctgtgctagcaaatagttattgtctaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgaccaacgtggatcatcccactctgccttagcaggaataacgacagttttcatattcgctgctttgcctgaaatcatacctaatacagaatcttcaacggcaaagcattcattgactgtggcactgagttataccactccatagaaaaaaaacatataaacagaattgagcatttttagagccaagataaacgtcatttactcaagtttaacagtatttccaaagtacatttggaattgtatttgaaggaatgcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcgttttaatcacagtaacttaaagctcaaatttccatttaaacataattagttaaaggcggtttaagttagttatctagcccctatttattatagttaaaagcccctttatccgctgataaaaggggcttggaactacttgaaatttattcctaaactatctcgtagtaatctgactttaaattaaaaaaactaacagatacaaagtctgagaaatagtgtttaactacatggggttaaatacgtttaaagtctaagtgaacaagttttggtttagttggatgacgttgaatcgcttgtacttttacttgctcttctttacccgcaacaacgatagttaacacttcgttgtagaacgcatcgtgtacttgtgcgttgtttactttatcgtggtctaaaatgattgatacagcttctgctttaccaccgtagatgattgcaggaacttgaccattgtgacgcaggcggcggctcgcacccttaccttgcgccgaacgaacttcagcttcaaatttgaatgacataattaaattctcataaataaaaagggaacctaaggttccattgatacaaaaatagcaggcgacccagctatttccctaaatttgacggttaaaaaaccgagtgcgtattctaatgaaaatttaagaaaaatcaaacattacttcgctgcttctactttttcaacagtatagttcagtaagtaagcgtaatttttcgtaatttggtaagaaacttcacaaaagtattgtaaaatgcgtcgtttttttattctttctatcgttttatttaataggagtaatgaatgactatcgctcagtcaaacacgcatcttagccctgagaacattcaaaatgtcaaaaatgccattttgcataaacttgtttttgctcttggtgtagaaccgcgtgaagcaagcaaacgtaactggttaaatgcggcattgcgtgttgtgcgtgatctttctacggaatcttggttacaaactcgtcgtagccaagcggcaaatacaagccgtcgtgtttattatctttctatggaatttttaatgggaagaaccttcagtaatgctatgattgcagaaggtgtttatgatctaattcgagctgcgtttgacgagctaggtcaaaatcttgaagacattattaatgaagaaggcgatccaggcttaggtaacggcggcttaggtcgcttggctgcgtgttatatggacagtcttgcagcaatgaagatccctgcgattggctacggtattcgttatgaatacggtatgttccgccaagagataaaaaatggcgaacaagttgaaaatccagattattggttagaaaatgaatttgcgtggccttacttacgttcaagtaaaaaattccctatacgttttggtggcagaacttggcaagaaggcaaaaaaaccgtatggcaacctgatgaagaaatcattgctcaagcccacgaccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccaggatttaaaaccactgcaaccaacagcttacgtctatggtctgcacacgcaggggaaaaactatttggtttagcagactttaaccgtggtgactattttgcagcaatgagccaacaaaatagctcagaaaacgtttctcgtgtactttacccagacgattcaacttacaacggtcgtgaattacgtttacgccaagaatatttcctttgctctgcatcagtacaagacatcgttcgtcgtcatgaagtggaatcgggatcttgcttaaatcttgcggaaaaagtggcaatccaccttaacgacacccaccctacccttgcgattcctgagttaatgcgcattttaattgacgaaaaaggttatagttgggaacaggcatggaatacgactcgcaaagtattcttctacaccaaccacactttaatgagcgaagcgttagaaacttggcctgtggagatggtggctcgtatcttaccacgtcatttacaaattatttttgaaatcaacgattggttcttacaagaggttcgtcagcaattcccaaatgatgaagaattaatccgtcgtgtatctattattgacgaacaaggcgaccgtcgtattcgtatggcgtggttagccgtgattgcatcaggcaaagtcaatggcgtagccaaaattcactcagacttaatggtggagtctatttttgccgattttgcgaagatctacccagatcgcttcaccaacgtaacaaatggcgtgactccacgtcgttggattcatatcgctaaccctggacttgcctcgattttagataaacgcattggcaaagaatggcgtaccgatttaactcaattagataaattcaacgcctttgttgatgatgcagatgttcaagctgaagtggctgcagttaaagtagaaaataaacgtaaactcgccgcttatgtagaacaaacccaaggcattaagctcaaccctgaagcaatttttgacgttcaaattaaacgtattcacaaatacaaacgtcagcaattaaatgtgttacacatcattgctcactataaccgtattttaagaaacccaacagcagattggcagccacgcgtctttatctttgcaggtaaagcagcaagtgcttactatgcagcgaaaaaagtgattcgtttaatcaacgatgttgcaaatgtgatcaacaacgacagccatattcgtgatttaatcaaagttgtctttattccgaactacagcgtaagccttgcacaattaattattccagcagcagatgtgtctgagcaaatttcccttgctggtacagaagcatcaggtacatcaaatatgaaatttgccctaaacggtgcattgacaatcggtacccttgacggtgcaaacgtggaaattttagatcgtgtaggtaacgacaacatctttatcttcggtaacaccgtagaacaagtggaagagttacgtcgtaacggctattcgccgtatcactactacgaaaaagatgcagaattaaatgaagcgatttctcaaatcttaaacggtaaattctcaccagaagatccatatcgctatcaagatttaattctctcatcaggcgacttctatcaagcctgtgcggatttccgtagctatgtagatgctcaagagaaagtggcaacctacttccgcaataagaaagcgtggacacgttctgcgatcatcaacattgcgaatatgggctacttctcatcagaccgctctgtgttagattatgcgaaagacatttggaaaattgaaccaatgaacgaaacgcaattatcttctcagccgaaagtagcggatatgatgagtaatgcgagtaagttgttagttataaaatgattttataactaatagactaagatacactctctagacatttggaaattctccattctactattgaataaaaatggagaatttctatctgcgctcatttataccttcctccaataaattagtgtctgacatagccccacacaaaatttaacgaataacctcgacaaatatatgaaatatttgggtataatcgtccgcttgtatgagggagaaattaagtgatggaaagttttttacacggttttgtggtctgttttgggctgattgtgtctattggtgcacaaaatgcatttttattgaagcaggggattttaaaacagcacgttttttgggtagctctactctgctttctttgtgatgttgcgttgatgagtatcggtgtattggggcttggttcgcttatttcgcagtcacctaccgctagtttattgcttgctctgtttggtgcgatttttttattcacttatggtagtcgctcttttatcactgcttatcaaggctcaagtcagctattggcacaacaagggcaagctaagtcgtctttaaagaaagtgatcgccattacccttgcgattacattacttaatccacacgtttatattgacactgtggtgattgtcggtggtattggcggcactttaagtttcacagaaaaaatacactttttacttggagcattaatttgttcatttttatggttttttggggtgggttatggtgctggtttactttccccttactttgaaaaacgtcgaacttggcagattttagattttgtcacagggttaattatgtatggcattgcatttagtttaatcgtgtatgcagtgaaacttattgaatgaagtagtcgccctttatttctattcttctatcatcaactatcctctttataatgttaattttttgtaaaaattcgacttatatcacagtttttctttaaaaaatccgtcataattggggggatttgtgtgactgatttataagtaagcatttctctttgactttttgcctttatttgtactgaaatgtatataatggcagcaaatttgacaactttgtaaacagataaaaataaggttaggtctttatgcaacataaaaactttgacgattggattgcaactactgcattaggtggggcaaatcagtcttatgttgaggaaatctacgagcagtatctagaagatactgatagcgttgatgcaagttggcaagcggtatttgctcaactgccaaaagctacccaagtagagcaacctcattccagcgttcgtgattatttccgtcgtttagcgcgtgaaaatcgcagtgaggcggtgacagtgattgatcctgaagccagtgcaaaactcgttaaagttttacagttcattaatgcctaccgcttccgtggacatttggaagctaaattagatccgcttaattattatcgttggaaaacctcacaggttcctgaactcgattaccgttaccacggtttcagtgataaagatttagaagaaacttttactatcgggcgttatgtttataacaaagatacgatgaagctaggcgaacttgctgaggcgttaaaggaaacctattgcggtagtatcggtttggaatttatgcacattcaggatatggagcagaaaaattggcttcaggcgaaaatggagagtgtgctgaataagccgttattcacgaaagaacaaaaagtaaatttattaacggaactgaccgctgctgatggtttggagcgttatttaggggcgaaattccctggtgcaaaacgtttctcgcttgaggggtctgatgcttttattccgatgatgaaagagattatccgtcacgctggtcgtcaaggtatggaagatgtagtgatgggaatggctcaccgtggtcgtttgaatatgttagtcaatgtgttaggtaagaaacctgctgaactttttgatgagtttgctggtaaacacgccgatgataatcgtacaggtgatgtgaaataccatcagggcttctcgtctgattttgatgtggacggtaaacacgttcaccttgctcttgcgtttaacccttcgcacttggaaattgttagccctgtggtgattggttctgtgcgtgcaagacaaactcgtattcacgatactgaacataagaaagtattggcgatcacggttcacggcgactcggcggtggcaggtcaaggggttgttcaagaaaccttgaatatgtcaaatgcgagaggttacaaagtaggcggaacaatccgtatcgtgatcaataaccagatcggttttacgacttctaatccaaacgatacccgttctacggaatactgtaccgatattgccaagatgatccaagccccgattattcacgttaatggtgatgatcctgaagcggtggcatttgcagcgagaatggcggtggaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgagaatggcggtggaatatcgttgtttatttaaacgtgatatttttattgatttaatttcttatcgtcgtcacggtcataatgaggctgatgaacctttggctactcagccgatgatgtacggtcttattaagaaacacccgacacctcgtaaagtttatgcggatcgtttgattgctgaaggggtgattacaggtgatgatgaaattgagatgatgaacctctaccgtgatgcattagacaatggtgatcgtgttgtgcctgaatggcgagaaatggatactgcgtcaatggattggttgcaatatctcaattatgaatggacatcgccgtatgagagcaaattccctgaagctcgtttcttagaaattgcaaaacgtgtgtgcgaatatccagaagcgttacgcccacaccctcgtgttgaaaaaatttataacgaccgtcgtgagatgtatcaaggcaataaactgcttgactggggtatggctgagacgatggcttatgcaaccctgcttgatgatggtactcacgttcgtctatcgggtgaagatgctggtcgtggtaccttcttccaccgtcacgctgttgtgcataatcaaaatgatggcacaggctatgtgcctttaacgcatttgcacgcaaaccaagggcgttttgaggtgtgggactcggtactttccgaagaagcggtactggcatttgaatatggctatgcaacgactgatccaaaaacattgacgatttgggaagctcagtttggtgactttgcgaacggtgctcagattgttatcgaccagtttattagttctggtgaacaaaaatggggacgtatgtgcggtttagtgatgctactgccacacggctatgaaggtcaaggtcctgaacactcatcagctcgtttggaacgttacttacaactttgtgcagaacaaaatatgcaagtctgtattccatcaacaccagcacaggtttaccatatgttacgtcgtcaagcgatccgtaaaatgcgtcgtccactgattgcgatttcgccaaaatcactgctacgccacccgcttgctgtttcaactttagatgagttgatcaacggtgagtttaaaacggtgatcggggaattagataatctcgatcctgcacaggttaagcgtgtggtactttgttcaggtaaagtctattacgatttactagaagaacgtcgccagcgtgtgaaaaccgatgtagcgattattcgtattgaacaactttacccttatccacatgaagatgtgaaaaaagcacttatgccttatgctcatgttactgattatgtttggtgtcaagaagagccattaaatcaaggggtttggtattgtagcaaacacaacttcgaagcctctattccagagaatgcgacattgaaatatgcaggtcgcccagcttccgcttcaccagcggtgggatatatgtcacttcataccaaacagcagacacagttggttgatgaggcattaagcgtttaattgatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagaatttaaatagaaggaaacaacaaatgacaatcgaaatcctcgttccagatttacccgaatccgttgcagatgcgaccgttgcaacttggcataaaaaagttggcgatagcgtaaaacgtgatgaagttattgtagaaattgaaaccgataaagtggttctcgaagtgcctgcgactagcgatggtgtgattaccgaaattcaacaaggcgaaggggcaactgttgtaagtaaacaagttttaggtattttagttactcagcaagcaggtgatgtgtctttagcgacaattaaaccagtaaatgaagcaaccccttcagatcgtcaaaccgcctctttagagccagataatagctcggctgacgcattaggtccaagtgttcgccgtttacttgcagaacacggtttagaagctagtgaggtgaaaggttcaggtgtaggtggcagaattactcgtgaagatattgaatctgttgtggctaaacgtaatgcgaaagtggctgagaaagttgaaaatacgatcagcacagtggcttactctgctcgtagtgaaaaacgtgtgcctatgacccgcttgcgtaaacgcattgcagaacgtttattagaggcgaaaaatactacggcgatgctcaccacattcaatgaagtagatatgaagccgattatggatctgcgtaagcaatacggtgaaaaatttgaaaaacaacacggtgtgcgtttaggctttatgtcgttctatatcaaagcggtggttgaagcattaaaacgttatccagaggtgaatgcttctattgatggcgatgatgtggtgtatcacaactattttgatgtcagtatcgctgtttctacccctcgtggtttagttacccctgtgttacgcgattgcgacaaactttcaatggcagacattgaaaaagctattaaagcactggcagaaaaaggacgcgatggtaaattgactgtagaagacttaacaggtggaaacttcactatcactaatggcggtgtctttggttcattaatgtccacgccgattatcaatccaccgcaaagtgctattttaggtatgcacgctattaaagatcgccctgtggctgtagacggtcaggtggttattcgtccgatgatgtatcttgcactaagctatgatcaccgtttgattgatgggcgagagtctgttggtttcttagtagccatcaaagatttactcgaagatccaacacgtttgttgttagaaatttagaatgaacatttccccctttgaaaaagggggaaaacagttttaatcacataggaaccccaactctatgaacctacacgaataccaaggcaaacagatctttgccaaatataaacttcctgtcagccaaggcattgcttgtaaaacggcagatgaagcggttgaagcaatcaaacaactcaaaggcgatgcttgggcaattaagtgccaagtccacgcaggcggtcgtggtaaagctggcggtgtcaaactggtacgaaatgaagcagaagtgcgtgaatttgcagacaaatggctcggtaaacgcttagtgactttccaaacagacgcaaatggtcagcctgttaataccctatatgttgaggaaacagcagggattgcccgtgaactttatttaggggcagtaattgaccgctcatcacaaaaagtcgtttttatggcttcaagtgctgggggaatgaatatcgaagaagttgcggctaaaacccctgaattgctacataaagtcgctatcgatccgcttgtaggtggaatggcatatcaagggcgtgaactagcgtttaaacttggtttaacaggcgatcaaatcaaacaatttagttttatcttcacacagcaggctaaactctttgtagaaaaagatctttccttactcgaaatcaacccacttgtcgttaccactgaaggcaatttactttgcttagatgccaaaatggtggtagatggtaatgcgttatatcgccagcctgaacttgccgcaatgcacgatcctagccaagatgacccgcgtgaagcccttgccgagtcgcaccaacttaactatgttgccttagatggtaacatcggttgtatggtaaacggtgctggacttgcaatgggaacaatggatatcgtcaaattacacggcggtttcccagcaaacttcttagatgtaggtggtggtgcaaccaaagagcgagttgcggaagcatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgcggaagcatttaaaatcatcttgtctgacaaagcagtgaaagctgttctcgtcaatattttcggcggtatcgtccgttgtgacttaatcgctgacgggattatcgcagccgttaatgaagtaggagtaaacgtacctgttgtcgttcgcctagaaggaaacaacgcagaacttggacgtgaaattttagcgaaaagtggcttaaatatcattgcagcagcaaccttaacagatgcggctgtagaagcagtaaaagcggcagggggtaaataatgtctattttaatcaacaaagataccaaagtaatctgccaaggttttacaggcggacaaggcacattccattcacaacaagcccttgattatggcacacaacttgtcggcggtgtttcaccaggcaaaggtggcacaacacacttgggtttaccagtatttaataccgtgcgtgaagcagtggaagctacaggggcgacagcaacggttatttatgtaccagcaccgggttgtaaagatgctattttagaagccattgatgcaggtattcagcttgtcgtttgtatcacagaaggtatcccaaccttagatatgcttcaagtgaaacagcgtttaaaccaaacaggcgtgagaatgatcggccctaactgccctggcgtgattaccccaaatgagtgcaaaatcgggattatgccaggcagcattcataaaaaaggtaaaatcgggattgtttctcgttcaggaacattgacttatgaagcagttaaacaaacaacagactacggttttggtcaatcgacttgtgttgggatcggtggcgaccctattccaggttcaaacttcattgatattctaacactattccaagctgaccccgaaactgaagctattataatgatcggtgaaattggtggttccgcagaagaagaagcagcagcctttatcaaagcgaacgtgactaaacctgtggtgagctatattgctggcgttaccgcaccaaaaggaaaacgtatgggacacgcaggggcgattatctctggcggaaaaggcactgcagatgaaaaatttgcagctcttgaagccgcaggcgtaaaaactgtgcgtagtttggctgacattggggtagcgttgcaagcggtgttaaataaataaccgcttgttgatcagaaccgtagaagcatgcctaatctggcaggagctgtaattatagaactggcagattaggtttaatctttacgatgaaacttgctctttagagcaattatttactgtcttacacagaaaaactatcttcagaaccttttcttatatttagtgcggggaattaaagaacccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaaagaacccagcttcttttttctcccttgctctgtccaaaatattctgaatttcgagcattgtttcctgatcttcagctagtgcaatttttcgcatttcttcattcttaaagagttctaaattaggatcatagacttccgccattaatttcacattatggcgatctcgttcaaaatagtagtcacaaatttcatcagcaacttcttcctcaacacctagcatttttaaggccgcacgtccactgcgtaaggcagaatcaaaggtctcacgcacttgtttatctgctcctgctttgtaaagttcaaagacatgaactcgatcgtatgcccttgcgataattttgatattcgggttcatagaacgagccagctccacaatatgtatcgcttgatgtttatcatctaccgcaacgattaataattccgcagtttcaatccctgcattgtgaagtaattctggacgagtagcattgccataatagcttttaattccgtactttttcgccccttcgatttgcgcttcgttaagatcaataatagtagggtgatagccagacatcgtgaggatatgattgacgatttgtccataacgcccaatcccaactaagataatcgggtgctgttcttcaatatgagcggcttcacgttccccagctttgtttgcaaaacgaggtgctacgaatttgttatgtaaaatgatggtgattggggcaaaaatcattgaaaatacgacaatagcggttagatttgcttgaatttctgcagaaatcaccccttgtgttgccgatgctgcatatagtacaaaggcaaattcaccaccttgagccatcacaacagctctatccattgcatcgctggtgctacttttagcaagtttggctattaataaaatacacaatgatttcactgccatcattgcaatcactgccgaaaggattagaacccagttatcaaacacaatgtttagatctaatgccattcccacacctaagaagaataagccaagtaataaccctctaaatggctcaatatcggcctctaattggtgacggaaacttgattcggagagtaaaacccctgcgacaaaagcacccattgctgttgataatccaccttcttccattaataacgcagagcctaaaaccacaaatagtgcggctgccgtcattaattcacggattttggttttcgctagaatacggaaaatcgggttgagtacccaaataccgaccaccaccaatgcggtcacagataaccctgcgataccgattttctgccaaataggttggggatcggcaatatgatttggatctgtcggtgcaagaaaggtgacaatggctagtagaggcacaataatcagatcttcaaaaagcaagattgacaccattcgctgaccacgaggactggcaatatcgcctcgttcgcttaatacttgcattacaattgcagtagatgttaaaacaaagcctgctccaccaacaaaagagatttgccaagaatagccaaacgccataccgacaaacgtaagcaagaccgcacaaacgaccacttgcatactgcctaagccgaaaatttgacgacgcagcccctataagtgagatggtttcatctctaacccaatgataaacagaaacatcacgacacctaattcggcaacgtgaatgatcgcttggggatctgagaaaagttttaaaccaaaaggacctatcacaagccctgcagctaaatatcccaaaactgagcctaagctcaaacgtttaaaaataggtaccgcaataattgccgcccctaacagtgtcacaacactaactaattgacttgcaccttctgccgccattgattacctcaaaaaataaaaaattaaaccgtctaatgtttaaatctttttatagacgggtaattcatattgtaaatataaaataaaattagataaatgcttaatttaaaaattaattatctactataatgaaagaaacaatagctctaaattacttcataggagcagagtgatatctccacctaaacaatacgaaacaagggcggacacatcggtccgcccctactttgataataaattgataaaaagagatcgcttgtagggattatttaataatctctacaccacccatatatggtttcaacacttcaggcacagtaattgaaccatctgcattttggtagttttcaagcacggcaacaagcgtacgtccaacagctaaacctgagccatttagggtatgaactaaacgagttttcttatcccctttcgctttgcaacgtgcttgcatacggcgagcttggaaatcccacatatttgagcaagatgaaatttcacggtaggtattttgtgccggtagccacacttctaaatcgtaggttttgcttgaaccaaagctcatatcgccagaacagagtaacattttgcggtatggcagattgagcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcctgttaattcttcaagggcttccattgatttttcaggggcgacgatttgtaccatttctactttatcgaactggtgcatacgaattaagccacgggtatcacggccgtaagagcctgcttctgaacggaagcaaggggtgtgagcggtcagtttcagtggtaaactttcttcgtctaagatctcatcacgcacaagattagtaactggcacttctgcggttgggattaaagcgtaaggtttttgtaccgcatttggatcttgtccttctaacggttgagtatggaacagatcttcgccgaattttggtaattgccctgtgccgtaaagagtatcgtggtttacaagataaggcacataggtttccacatagccgtgttgttctgtgtgtaaatctaacataaattgagataaggcacggtgtaaacgtgcaataccacttttcataacgacgaaacggcttccagttaatttcacaccagcagggaaatccaaaccgcctaaaccttcaccaagggtaacgtgatctttgatttcaaagtcaaattgacgtggcgtaccccagcgagatacttcgagattttcgctgtcgtctttacccacaggcacttcatcggctggtaagttaggaatgtttaataacaactcacgaatttccgcttggactttatctaattccacttttgctgcatctaattcgctacccatcgtatctacttctgtcagtaacgcagaaatatcttcgccacgtgctttcgccgcaccgatattttttgaacgagcattacgctccgcctgtaaattttctgccttaacttgtaatgctttgcgttgttcttcaaggctggtaacacgagcaacatcaaggttgaagttacgtttgagttttaaaatttgtgcgacttcctcaaggttcgtacgcagaaggttttggtcgatcattttagtgtccttataaaatcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaggttaattggttttatattcgtttttcgataatttgagtaatatgtgcaatcacattttcaatactagaaataacttccctattattgaaacgcaacacatacaatcccagtgagtttaatgcttgatctcttattttatctgcttctatatgctctacttcataatgttgactaccatcgagttcaattacgagctttgcttttgggcaataaaaatcaacaatataagttaaaattggcttctgacgataaaattgcagatctaaaagttgttttctacgcaatctagaccataagatatgttctgcctttgtcatcgtattgcgtaatgttcttgcatttggtttaagttggaatagataaggttccataaatattccttaacattcccccctttgaaaaaggggggctaggggnnnnnnnnnnnnnnnnnnnnnatttcctacctattcgcattcttcataatccgctgtttagcaacttgccactcacggtctttaatatcttcacgcttatcgtgcaattttttccctttcgccaagccgattttgactttcgcccacgcatttttccagtaaagcgacagagcgacaacggtaaacccatcacggctgactttaccataaagcgtgtctaactcacgcttatttaacaataacttacgggtacgggttggatcgcatacaatatgggtagaagcaacatttaacggggtaatagtgccgccgaataaaaaggcttcgccgttgcgaaatgtcacataactatcaccgatattggctttgcctgctcgcagggatttgacttcccagccttgtaattctagaccagcttcgatttcttcttcgataaaatattcgtgtctggcacgtttatttaaggcaatcgtatttgaagctacttttggttttttactcatagtgttattttttattaaaaaaattaatgagattgtaccttaaatccagcctattatgtagcaaatgcccaaattttttatattacatttgcttactaacactattctgttgggaatttatcaaccaaacctatctgcgagcaaaaattgcaatacagcgtccattcttaaatgggggattggctgatcaaagtcgatttttttcggttcaaactggtcaaattcaaaacggtgattttgccagtagttgatgtcgggtaaacggtttggaacgctaccagggtagagtgtaaccagttttttatcactagagcgaaccccacggatcgctttgaaactttgtccattttgtgtggcgatcactggatcggtcgctcggatagcggaaatcgcttggtagcctgtgtcaatgccttcaaattcagcgtgtcgccccccttcttgcactaactgtcgcattaggctttctaaattcggtagttggtcgctggtgatatgatcggctttggtagcaacgaacagtaacttgtcgatattcgatgaaaataggcgactaaaaagcgagcggttgccataatggaaatgtttaaatagctgttgtaagcctgttttcatttcaataaaggcttgatggctgtgatttaacggggtaaggcaatccgctaagatcacttggcgatcaaactgtgagaagtaatcttcataaaatggtttgacgattttttgttgatagtggcgatagcgttttttcagggtgtgaaaaatgctatgttcagggcttttttctagctgttcccattcattttcgcttaaatcaagcagggggaagaactgatagacaggggcaccccgttcggtatttggcaggacaaatcgccctggttggatatattgcattccaacttctttgcatttgagtaggtaagcggtgtaatcttcacttaattttgcaagttggttttcgtctgttttggcggtaaggtcaagttgcttaacttgagcaagccaagcctgtgctaactctgcacgctcgcctttgtgtaccagctgttgatgttgcgaccactctttgaaactttgtgagagtagcggtaaatctaataaccattcccctgggtaatcaaaaatatcgagatagagtgtactcgtttctttgagatggcgaagcaggctatctcggcgttggtagcggatcgcaaggcgaatttcgctgatccccgtagtcgatggacaccaagtcgcaggttcgttctcgaagcagtggcggtttttgtcgtattcaaaacggggaatggtgagatcgtgttgttctactcgttttacggaaagaatttgtccgtttcgagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataggtttaagtgggcgttgtcgcctgtgccaatgtgtagcagttgatcgacaaaactggtgatgaatgcggttttaccactgcgacttaagcctgtcacggcaaggcgtagatgattatctaaaccacgttgtacgaatttgtgtaactgatgttgaagttgattaaacatataccgaaaattaccagcctaatgctttatgagcaacggcattgcgagccagtgaaaaatgagataaaccaaatagggcaaggttacgagcgacttgaataggcaaaaattcgcaaccaaaaatcgaaatcagaccgcttgtgctttgcataattcgggtttggtcggcttggcggtgttgttcaaactgttgtagccattttgcttcgccgaaatcttcgccttgtgcaaaggcttgaccgacaagggttgccaattcaaatagatctcgcattccaagattgaacccttgtcctgcgacagggtgtagtaactgggaggcattgccgacaatggctagtcggtggtgaatatggctttcgcttttttgtgaagaaaggggataaacaaaccgcttgctgacttgtaaaaatttgccgagcttccagccgaattgttgttgcaaggcgtgtaaaaagtcgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagtcgctgtctgacattgccattgcttctgtcggatcttccatacaccaaaccagcgacatcattttttcattaagtggtaataatgcaaaaggcccctgttttgtgaaacgttcaaaggcgtggttttggtgtggttcagacaggataacattggcaataatggcggattgttgataatccttgataaattgggttgttacgccacattgctgggcaatttgagattgaatgccgtcacaggcaactaacaatttggacgttaattgtgttccgctgtttagggtaatgtggcagtgctgttctgtgcgttcgatatgggcgacggtatcagggcagaatagctgaatgtttggttgcttggcgattaatgcggtcagttgctcgcccagtttggctaattccactaccacacctaattcggataaacgtagttcgtcggcttttaaggttgttttgccgaaatgtccttgatctgaaacgtgaatttgtttgatgggggttgcaatacggtaaaccagttgagctaaattttgttccgtggcaagcggtcgaatttgagctaacttttgcaaactgccgtaagcaaaggcgattgaacgtgcgtcaaaaccgccttgttgtgcatagtttggcgtatttttttctaagattgcaatttgcaattggtgtccgcttactgaacttaacgctaaggcaagtacagaacccgtcaccgcaccgccgacaatcaccacatcaatgttttgtttcatttggggattctccaaaatttacttccccctttgaaaaagggggattgagggggatttaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattgttattttacttcaatcaataccttaccactttccgctttcaataatctgccgacagggtaaagggcgacattggcattttttgcaatttgtttcacactttcaaccgcttgtggcttaacggcaattaataaaccacctgacgtttgcgggtcgcataaaatcgctttttgttcatcacttaacggcgaaatcagatgtccgtagctgtcgaaattacgggtagttccgcctggtacagcaccttgtgcgatgtactctctgacaccgtctaaggtttggatttgatcgaaataaacttcggcacgcaagtttgaaccttggcagatttccgttaagtgtccgagcaagccaaaacctgtgacatcggtcattgcagtgatttcatcgactttggcaaattcagcaccgaccaaattcatctgacacatcacatctcgtgctaaattttgatgttcaggttttaatttaccttgtttttctgctgtggtaagtacaccgatcccaagtggttttgttaaatataaatcgcaatcggcttgtgctgatgcgttctttttcacttgttcggtggaaataatgcctgtaaccgctaaaccaaaaataggttcaggggagtcaattgagtgtccaccagctaacgcaatgcctgcttgttggcacgcaaaacgaccgccatcaacaattttttgtgcaacttcggcaggtagcttattgattggaaagcctaaaattgcaatcgccataattggcttaccgcccattgcaaaaatatcactgattgcattagtcgcagcaattcgcccgaaatcaaaaggatcgtccacaatcggcataaagaaatccgtcgtgctgacaataccaacaccgttgccgatatcatagacagccgcgtcatctttggtttcattaccgactaacaaattcgggtcgataaacttcgcctgttctgtgtgcagaatttgttcaagcactttcggggaaattttacagccgcagcctgcaccgtgactatactgtgttaagcgaatgggttcgttttgcatggttgtctctttgttcttatttaacctaaataaagataacggaattgtagcagaaaattaagatatttatacaactgctacataataccaaattaaacaaccctaattctggataagaaaaacccatttaaaaacattctgttgaacacttttaaatgggttttcccctttgcgatgtttcgcgttacgctgataacttcctttacctttgcggttttgctctactcgacttctaaacagtttatccgtcaccaaggctttaattgtactctcttgaatttcaccacgctgatgggcgtagcattctgattttgttgattttttcattattttttcctttttgttaaacacgagatggtatatcttcagtgttgttggaagatatgtgcgaaattctgccaaatttctgtttaattgtatatatgcacagataaaaaaacggtataatctacggcgttattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttattcagcctaaattgaacttcttttcaatgcaagcggtctgaattaagaagaattttacaaaatccaaagaggtgaatatgaaaaaagaagaagttggacaccatttcttagctcgtttgggtaaaacacgtttacgcccaggtggcaaaatggcaacggactggctcattgcaaatggcgattttcggaaagataaaaaagtgcttgaagttgcttgtaatatgggaaggaccgcaatcgaaattgctcaacaatttggttgccaagtgatcggtatcgatcttgatgaagaagccctagaaaaagcacaacacaacattaaagagcataaagttgaagaattagtgcaaattcaacgtgcaaatgccaccaaactgccatttgaagataatagtttcgacattattatcaacgaagcaatgctgacaatgctaccgcaagaagccaaagaaaaggcaattcgtgaatatctgcgagtattaaagccaaacggtttattacttacccacgatttactgctcaatggcgataacagcgaagaggtgatcgctaagttgcgtgatgcgattaatatcaccgtagcacccttaaataagcaggattggaaagatacattccttcattgtggcttccgcaatgttgaaacctttagtggtgagatgagcttgttatctccaaaagggttaattcaagatgaaggggttttaggggcaatgaaagtggtgggtaatgcgttaaaaccggaaaaccgtgatactttcaagaaaatgttccagacctttaatgaccctgaaaatcaactaggctttattgcggtttgtagtcaaaaataatgtaaataacgaaaaagaggtaaatgtagggagacgctgagcgtgtccattgtggtaagggtacgagatattttatctttaccttaaaaacggacacacgcagtgtgtccctaccacaacaaaacaacattatcttgttaattgatatttgtcagtgatccatagtaggtacattaaacgcccctttttttatcatcataacaataaataaacgcaaaacacgacaggatagattatgtttgaaatgttcaaggattggtataaacagaaatttactgatccacaaattgtcgcacttcttgccatcttaattatcggctttggaacgatctactttttcagtgatctcttaatgccccttttgattgccattgtttttgcttaccttttagaatggcctatccgctttctaaccaccaaactcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaccaagaatgctcagcttagtgattgtcttaggcggatttatttctctctctgtctttttgtttgtggtaatgcttccaagtctatggaaccaagcagtgaccttcctaaaagacctgccgagtatgtttaacttgctcaatgcgtggcttgaggctctgccagaacactatccagaattgattgactatgcaatgctcgactccctaatggcaacggcaaaaactaaaattcttacctttggcgactccttattgtcgttttcattcaactcccttgttagccttgtcggattaggtatttatgcgtttttagtaccattaatggtctttttcttactcaaagataaaacgttgtttatgcgttctgcactacgttttatgcctaaaaaccgccaccttgctactcgtgtttggggggaaatgcaattacaaatcgccaactatattcgtgggaaatttttagaaattctcattgttggcgttgtaacttatattattttccttttctttgatttacgctatccattgttactctcagtagcggtcggtttatcggtattagtgccttatattggtgcggtattagtgacaattcctgttgcgttagttgcactctttcaatttggcttatcccctgatttctactacttgctacttgcttttgtgattagccaacttttagatggtaaccttgttgtgccatttttattctcagaagcagtaaatttacacccattaacgatcatcgttgccgtaattattttcggcggtctttggggcttctggggggtattttttgccattccattagcaactttagtcaaagcggtgatcaatgccttgcctaatgtagaagaatcgcaatcttaggcttgcaagcggttggatttcactataaattcacggttttatttatctcatattatacttattggacgccaagcgtggcgtccctattatttaaaggaactgttgtgcgtgtaaccgatttccattttgacctacctgatgaacttatcgctcgctatccaacggctgaacgaagtgcaagccgtttactttatctcaacggtaatacaggcgaatatcaagatcaacaattcaatgatttacttgaacatatccatagtggtgacttactgatttttaataacacccgtgttatcccagctcgcctttatggacgcaaagccagtggcggtaagttagaagtgttggtggaacgtgtattagacgaacatcgctgtttagctcatatccgttcatcaaaagccccgaaagagaatgctgaaatctttctaggggaagataaattaggagaaggaaatggctttaaagcgataatggtggctcgttacgatgcgttatttgagctgaaatttgaagcgtcacagccgcctttattcgatctgctacaacaggcaggacatatgccactaccgccttatatcgaccgtccagatgaagatgccgaccaagagcgttaccaaacggtatatagcaaagtgttaggtgcagtagcagccccaacggcaggcttgcattttgaccatcaaatgctacaaaaactgcaagaaaaaggggtacaaaccgcctttgttaccttacacgtcggggctggcacattccaacctgtgcgagtagaaacaatcgaagaacataaaatgcacgcagaatatgccgaagtatcgcaggacgttgtcgataaaattcttgccaccaaagcacaaggcaaacgagtgatttgcgttggcacaacttcggttcgctctattgaaagtgcagcacaagcggcagaaaaagaaggcaaattaatcgccccattctattcagacacggcaatttttctatacccgggaaaaacattccgtatcgttgatgccctagtcaccaacttccacttgccggaatccaccctaattatgttggtttccgcctttgccggcttcaaaaactgtatgaacgcttatcaacacgccgttgaaagtcaataccgtttctttagctacggtgacgcaatgtttatcacgaaaaatgaaaatgcgttgggggatgttccctaaaaacgaaaacgcttagaaatttacgctacccaccacgcttcctagattctacttatagcaactgtattcttacacagttgctatgtagtcaataaatatgtataaaaattattctacttgaaacaaaaaaggattaatcgcactgcgtgccagccctttttgctccatttcagcatcaaggaaaagcgtacctaaatcatcggcgattggctcaacatgcggatctttatcttgatacatcactttcagataactctcacaatcaccacaactttccgctttcacctctgcgtccatactgtctaagctccagtaatcgagcttgcctgtctgctcacaattactacacttcgcacgcaccatattccactcgctttcacatagagaacagtgcaaataacgtaaaccttgcgtttccccaaaatgaaccacactggcaatcggggcagagttacacacagggcaagtatggcgttcttcaccgtactccgctttggtattgcgaggaagttgctgagttaattgcacccaataaagcgacaagaccgcccataagaaaaccgccttgtctgcgcccacctcttcataacgctcattcaacaaatgatccgccagcatttcaagctcagaatttgaggctttctctaaccattccaatgtcgccaacacagtatccgacgcataaggcttaaacttatcaataaacgccaacagcaatttctgccactcatctgaccgcttaaaggttttcacatctaaaggcttcactccctgatgagcttccaaataagcggtaagttcgcccactctatttgcaataggctgattttctaataaatcaagctgaacctcgacaatatttgccacaaattccaaataatccccaaaaggattatgttcagccaattgtcttaaacgtttagctcggcgagcatataaatttttaggattggcatacaacaacggcggattgtgaaaagagcttgcagcttgttgaatttcttcttggggtaaaatacgaatactcataattttttatacctatatttactaaaaattaaatattacttgctattcaacatctttcggcaatttatataactgatgtttatataaataactgcctaacaatgcgtgggccagtgcctcttttttcattgcttcagactgctcttttgggttaaggcgttcattcgctttatcatattcataaccttgaggagattgatttggcttaagaataatcacatctttgcctttcatcattgcttgcgtttggtcgtactgcataaacgcacgatttggatcgacattttgagttaagtcaaagccaatcatcggataatcgccactaatgcctgcgacagataacaatgtcgttggcatatcaatttggctgaccaaacgattatcacggcgaggctcaatatgttcccctaaaattaaggctgggatatggaaatgtttgatcggcacaagactatcacccgctactcgcgagtcgtggtcagcaatgacaaggaataccgtatctttccaataatttgattgttttgctaatttgaagaaatgccctaacgcataatccgcatattttgccgcattattgcgggtctgtttctctttatcaaacaactcaattttaccgtctgggaactcaaatggatcgtggttacttgaagtaaagactaagctaaaaaacggtttatcgccttttgctaattcggtaaaggtttcgtgtgctttatcaaataaatcttcgtcactcatcccccaagtggaaacaaacttcggatttttataatctttctcatcaatgatggtttcaaagccatttccataaaaatagctcgccatattgtcgaaatgtttttcaccgccataaatgaaagaggtgcggtaaccttgacgacgcaataattctgcaatggtaaagaaaccgttttggcttttggttaatttcactgttgcacgcgctggcgttggtgtaaaacctgcagtaacagcttcaataccacgcacagaacgtgtgcctgttgcgtagatattttcaaacaaccaaccttctttagcaagttgatcaaattcaggagtaagtggcttaccgcccaatgtgccgacaaactgagcgccaagactttcttctagcacaataacgatatttttaggcttaccttgatagcttgccacattcttggttaatgtcggaataaccgttgaaatataatcagaagcggggcgattacggctattttttacaatctcaaacatctcttgttcagacattttgccatattgctctgaagatttttcttcatctttcagctgttgtacggcatataatacagagtagcctgaattgagaaccaatgaattaaccagtggatcgcttgaaaatgccaccattgcagggttaatgccacgatgtcccaatgatgatcttgccccagcaaatgccactgcaataatcaacaatgccattacaggacgcagtttccagctaggtaaacgcagatgttgaacagcccagccagacagcttccaataaataatgcctgcgactgtagttgcaaccaaactgctaatcactgcagtcaaatgcccattggctaacattgtaaatacttcttttggataaagtagatactcaataaataggcgatttgggcggaaatcataggtttcaataaacgcaggggtggcgacttccataaatagaataaacacactgcttatcgtaagccaaacgcgtaaaatacctttccaaagtgtgcctaacccattgttatgcaccaataacaccgtaaataatgctggtacgccaaagagataacaaatggagacaatatccatccgcaagccttgtaggaaaagaggaaaccagccctcaaccgcagaaacacgatctgcttgccacagagataatccaaggcgtgacaggctgaaaatcattaaatttaatccgataaagaaaaaaatcggaaacaaaataaagcgggtatttttttgcataaaattactctgaaattgtaatgtaatccccaactcgaataacaccgcttgtttgtggcactaaatgcaccccaaaaattggcttacctttctcattggtgtggtgttgttttaaggtccgaaaaggttctgtattcggatctaattcaagggtctgtggatctcgggtaattaaaatacagcgtgtgcaaggttgagccacctcaaattccactgtgccaattttcaccctcttccacccttcttcttcaaaggcttgaatgccatctatgacaacatttgctcgaaactgttccattgaaacaggcacaggcgaccattgttgtagttgttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggattgctcagataccaataaaagcggattactgtctgcaaaacttaacggttgaggttcacaatgttttaccattcgttgtggctgttcgcctaaccaacgtaactgaacttcacgcccaaatttttggcttaaccattgatttactgtactattcgccacccaagatggaaaatggtttccccacacttcgctagattgctgttgcgtaaaatcattataccgtgccacacaccgctcgccacaatcagattgaataacaatccccgttgaaataggaaatgccgctaaacgatataacatctgctctttacgagccgtgataaaagtaccatcgacttcggtaatcataaattcacggtcaaaattcagcccttgtggtaaaacaaaagcctgctctacccgatacgccttagtggatttaattggataaagacaaatttgtgtgacttgcataagctcccctctaaatttaggcgataaacaatagcagaaaatcatctacttttatatctttctcaagtaaaatatcgggattatttgaaaaggaatagactatggcaaagaaacctaccctagattttgaaaccacactcaaagagcttgaggaaatcgtcaatcgtcttgaaacgggcgatcttcctttagaagaagccttaaatgagtttgaaaccgcagtaaaattggtgcaacaagggcaagaacgcttacaaaaagcggaacaacgtatccaaattttgctacaaaaaaatgaacacgcagatcttacggattacccataatgaattacgaccttttcgctgaattaagtcaatatcaacaacgtatcaaccattttctaagcgagcaactttcgcaatatccggcctacaacacaccgcttattgacgcgatgtcttatgctgttttgcttggtggcaaacgagttcgccctttcttaatttatgctacagggaaaatgctaggcgtaccacttgctcaacttgaccattcagcaggggcaatggaagccattcacgcctattcattggttcacgatgatttacctgcaatggataatgatacccttcgtcgaggcaagccaacttgccatattgcttttgatgaagcaacagctattttggctggcgatgcactacaaagttttgcctttgaattactagcgtttgacccaagtctaaccgcagagcagaaggtggcacaaatgcagtggcttgcaaaatccgctggggcaaaaggtatgtgtttggggcaaagtttagatttacaatctgagcataaagccattgcccttgatgaacttgaacgtattcatcgtaataaaaccggggcgttgatccttgcctctgtaatgatgggatttaatctatccgcttacgcccaagatcatcagattaaacaacaacttgtgcaatatgctaaagcaatcgggctggctttccaagtacaagacgatattcttgatgtgattggtaatagtgaggtcattggtaaaaccgcaggttcagatcaagcgttggataaaagcacttatccaaaactgctgggtttagagggggcgaaacaaaaagcggagagcctctaccagacagccctaaaagcactagaaaccttgccttttgatactacggctcttgttgctttggctgaatttattgtgaaacgtgaaaattaacccctgtttacaggcataagagtagtacttatgcctatttacttatcaatgatttaacccaagcattatcataaacaatgccccttgcacttcagcttcaggaacatctctgccattcaaattgactttcccctgatcaatggatagcttcattttcaggctatctttatccaaagtagctaatgagctggcttgagcttgataggcaaactcactgatcgtttgttttgccttctgttcagcttcttctttcggtaagccttcctgttgatttagctgtgtcactaatacttctaacgaaggtaacttgaattgagtttctaacactgacgctttaaatatttttagaacatcttccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacatcttccattcctttgaattgacttggatcgaatttatctaaatttaaattcaaagacagactattttttcctttttcgttctctaagctaagctctttaatttgtaatttcggcgatttnnnnnnnnnnnnnnnnaccacatcaccagcttccgcagactctaatttttctagggaagaagcataatgcattaattcattagcactctctgcgtcaagctccatcgaactatcaatgttgagcttacctaagttaagtttatcttgagctatcaactctccagtaaggctccccgttgaagtccagcgatccttttctaaagtatttttaccctgactggaaagatttgtgaaagcaaaaggtgcttttccgtcagacgagtaacgaaccattttagaactgaactcataattacccaaactaagctctggatatttctcatttgaggtaaaatccgctttgtaaagggtatcttggatttctatcctagtatttgtttgatcttgatattgataggacggaatttggctactgaatttccccgatttttgtgctggatcgtactcgaactcaatctgggtctttgcaagatcccaagtttcacctttgaaagcattgaggctaaactcaccgcttaaattacctgcgtagctaatatccgtttgcccttcggtaaatggggtctgtagcttgaatttttcaggtaaataaagtttgctctcaacgctcatcattgcaggcattaagttcacttggctaaggcgatttaacggtaatggaccgtgaaagagtttatcatcgccttgtagctgataacgttcatcaaccgttcctacctctaaggtatatttcacatcagaactgaaaaaatggcgttcaaatttaacatctttaatttctgcatctatgccatagatcttcagtgctttcaggctttgattaccttgttgaaccaattgctgatagcgttgttctgcttgttgccctgtgtaccaactgcccccaacaacagcaatgccaagaatgccagccagagcaagggtgattttagttaatttcattgttgttcctctttattatctctcaattaaaatggtagaaagcctttagttatgccttttccgccctttctaccaaccactcacaaggcgtaaaacgctcgccatattgttgtgtatgtttgcgtaactgacgaacaagctctttagccccaatcttgtcaatataggcatacacaccgcctcggaaatctgggaaatccaccccaaatacagaagcaacgttaccttcatcggtggaacgaataacttgatcttgtaaacaccagcaggcttcattcaacattctcaatacacaacgacgggcaatatcttcggcttccatttcattttgcataatggtttccattgtgtgataaacactcttatcctcttgagtgcgttttcctcttgtgtcgtagagatagaagccccgtttattttttcgccctttacgatcatcgccagtcaaacgttcaatagtcgtcggtaaagcaaaacgtttacccaattcactcaccatcgctggattagatttaacaataatatccaagccaatttcatcgatcattgcaagcggtccgatcttaaagccaaattcctgtaaggcacggtcgataaattcgatcccttccccttcggataaacactcgattgcttcaagtaagaacggcgtaagaatacggttaataaagaacccttctttatccgcaacaagcatcggaatttttccttgctggatcgcaaaatgaattgccgttgaaaccgctcgctgacaagttttttcgtgcggaataatctccaccatcggacgtttagtcacagggctaaaatagtgcaaaccgattacattttcagggcgtttggcgacagaagcaatgtcacggattgcaaaggttgaggtatttgtggcaaaaatcgcattttcttcgtagtaattttcactctcttgcaccatctgctgtttgagttctaatttttcataaactgcctctacgataaaatctgtcgatttcgccgcaactaagcgttcaccgcccgtaattaaattcattcgttggatcatttcaccgtgactaagctgtttcttactcactgctttttgcattaagccataacaagtctgcaacgctttttgaatttctgacgggtgaatatccttaattctgacaggaatttgagcattatttgccgtcaagtaagcaatacctgcccccatatagccactgcccaacaccgttacttgttgcacatctcgcacctgagccaagtgctgatattgctctttcattgcacgttcagtctgcttcaaattcattaatacctgagcttgctccgtgtgcattaacttcaccaacgcattttgctctaaagctaacccagctttaaaatgtggctcttttaacaatgccaacatttcctcaactgcaggatagttgccaaaagccttatcccacactcgattttcaatatgagccaaatatttttcacggataaacttattgccctcaagctgtttacgccatcttttgagcttatcaagcggatttttatggtcaattttttgcactttatgattaagcaacaactgatatgccgtttcaaatagattgctagcaggaataagtttatccaccaaaccaatttttaacgctttttccaccccaattttctgcccagataaaagcattgtgactgcattttgcaagccgactaaacgaggcaaacgctgtgttcccccagcaaaaggcaaaatccccgaacgaatttgtggcattgcaaatttggtataactttcctcgctggcaatacgataatcacacgccaacgccaactctagccccacgccataacagccaccatcaatcactgcaaccacaggcattttgagcgtattaatttcacgcattactaactgagcattatgagataaggttttcagctgttcatcatttttaccacgcaaatgatcaggatcataaccttgaataaaacctttctccttacccgaaacaaaaatcacgccccgtgcttgttgataaatcacagaaccaatcacatcacgtaaatcttcaataaactgctcaggcaaccagttttgcgatttcccttttacatcaatacgaacaatggcaattcgattatcatcaatctcaacgtgaaaaggtgagatatattgtgcttgtgttgtcatactgttactcgctttccaaaatcattgcagaacctaatccacctaatccacttgaggcaatcaacaacaatccacctcccttacgtttcaacgctttcaacgattgaattaaaatgcgtaaactggtcgccgcacgaggattaccaaaagcaatagaaccgcccaaatggttcaacttctcaggatcaatttccccaatacaagcggaacgattaagctgttttttagcaaaatcatctgaagcaaacagcttcatattcaccagcatctggctggcagaggtttcgtgaatatcaataaaatccaaatcagacaaggtcacatttgcacgctcaagggcaagatagcttgccaccgtcgcccccataaacatattttgccaaatatcgttacccgcaatggcatagctacgaatataacctaacggctctaaccccagttctttcgccttgttctctcgcatcaataacactgccgccgcaccgtccaccgtacgaggcatatttgcttcggtcacagtggcataacttttattcattaacggcgaaaatttttcataataagccactttagaggccgaagaaatcaaactatcagacaccacaaaatcggtataaggacgagggaatgaaggcatcacttcatcttttaacacccccaatttccacgcattctgagctttgatatgtgaatttaacgcatattcgtcctgagcttcacggctaatgtgaaactgctgagccatctgctcagaaatttccgccacggacatttgggtcatataatctttgagattaaccccgtgaggtttaagctctttccacgaaaactcacggaacaagcgatacttatcatctaaggttggagcattaaaaattgccttgagcttatgaataacacgagggctaatactaaaaggggcattagaaatcgagtccgttccccctgcaattcctgcagaaatcgaaccgctaataatactgccggcgacattcaccaacgcttgcaacccagataaacaagagctacttaaagtataagcctgcacataaggcatatttaacgccaaggcaatctcacgagaagggttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacgagaagggttaggaatatcaggctgttgaataacttgcccaaagacgagctgttcaatatgttgatgatcaacggcagtacgactaagtagctcgtttgttaccattgtgcctaaatctgttgcataggaagatttaaatcctgtatcacgatgaacaaaaggtgtgcgtaatccagcaacaatcgccactcgctcaccttgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgttaagagattttgtttagccattttatagataattcaagatagaaatgatgcggattttatcacgctttatctagaataaaaaatggctcaatcacatttgattgaaccattccattcgcagtaacaatttatttatagatcatcaatgaccacataaaccttattcacaggtccgtgtacgccgacaactttgattaactcaatatctgccgtagcgcttggccctgaaataatgtttacacaagatggcattctttcgccttgttgggctttgtcgtgtaggattttagctaactgtgccacacggggtaacacggtgctggcacgcaagacgacaatggatttttcaggtaacaggctgactgagcgtccaaattctttatctgaaaacagtacaataccgccagattccgttaagccgtattcgccgtaaaccacgccgatattggctttttccgctttgtcgatattaacactaccatctgaattgtgatcccaaacatagctgtcgtatttagcttgtagtgctggcgtaatgcctaaatcaactaaacggctgtcgttattaataatcaccgagccaccgccatatttatcacaaagtgcggtcacttctgcgatcagattttcttctttcaccaccgccacatcggtcatcatcactttagcaaagctaacaaattcctcgactaattgagcttgagtgcgatccgttaagcgtgtcgttggataatcattgactaatttcggcattggttcaggcacgagctgacgcggtctgcccattctttccgccagtttatttagaaaattttcacggttttgtaaatccattctcttatcctctgttgttgaaccattcacggaaactttcgccttcggctgacggtaaatcacgggcttttgtccattctgcaagcgctcccacttgaattggtgctttgccgtttttgatgaatttacctgccacttttgccccgatattcaccccgactttccataaagttgggtgcgagttagcaaagttgaaaccgaaaatcgacaaacgctctgctgctggggtcataccattttgagcgatatgttcacggtgttttaagatcagttgtgccagaggaatttttacagggcaaacagagttacaagcggtacaaagtgaacaagcataaggcagttctttaaattcttcatagccaccgagtaatggcgagatcaccgatccaattggacctggatagatcgagccgtagccgtgtccgccgatttgacgatacgcagggcaagtgttcaaacacgcaccgcaacggatacaacgtaaaacttctttaaattcgctttcaaggatttttgaacgtccgttatccacgataactaagtggaactcttctggcccgtccgtttctccttcaagacgtggtcctgttagccaagtgttataggcagtaagttttgcaccaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcaagttaccttcgttggtgactaaacagacagaacctgtttctgctacggcaaagttacaaccactaatgccgatgtctgcctctaagaaatctttgcggatcacttgacgcacaaatgcagtcatttcctctggcgtttctgagccgttatagcccagttgttcgtgtaattcttgacggattttatagcgatctttgtggattgcaggtacaacgatgtgagatggtttatcgccaacgatttgaagtaaatattcgcctaagtccgtttcaaccactttaataccttcgttttcaagaacgtggtttaagccgatctcttctgtcaccattgatttggatttaacgatcttcttagcatttttttctaaggcaatttgacgaatataagcggtcgcttcttcggcagtttctgcaaaaaagactttaccgccgttttgttgcactttttcacttaattggtagagataggcgtctaaattggcaagaacgtggttacggatctgttttgccgcgtcacgccactcttcccagtggccaagttcgtccaccattctttgacggttcgccccgatggtttcttgggcttttaccaccgctttacgcatcattgcgttgtggatttgatcgtccacgcgttttttaaaggcaagattgctagtttttaatgacatcttatttgccctcctgcattaatacttcggcaatatgcattaccttaatatttttcccttcacgacttaaacgtccgccgatgttcatcaaacagctcacatctgcaccgatcaagtattctggttcaacatcagcaatatgctcgactttttctttaaccatttcgcctgaaatttccgccattttgaccgagaaagttccaccgaaaccgcaacaggtttgttgattttgaattggtaacaactctaagcctttgacgttttgtaataaggtgattggttcattcacaatacctaatttacgcgacaaactgcaagacgggtgataaacagctttgcctgttaaggttgcaccgacattggtaacgcccagtttattgacgataaaatctgttaaatcgtgaaaacggtcagcgacttttttcgcacgagccgcccactctggttcgccaaagcgttcaaaatggtcaggataggttttaattgcataaacacaagaacctgcaggggcaacaattggataatcattgacttcaaaagtttccactaactttttcattccctcaagggcttgttttgtataaccactgttaattgcaggctgtccacagcatccttgtttttcaaggaaagtgattttacaacccagtttttctaacaatagcacgctatttttggcaacacctgctttgacgatatcggcaatacaggtgacgtaaaaattcacgttcataaaaactccaataaataaaaatagtaaaaaagctaaaacaagcggttggattttacaaattttttggcatttatgttgtaaatctttttatattgtagggacgccacgcttggcatccctactctcaaatatatagccaaatttttatcacaatactccgcttgttcttcaacatttaaaaacgaaaggtggggtaataccccacctaagattacacattgtagaacaacggcacaataaagagtgctgaaagtgcggtaattacaccgtaaacaaacattggcataaccgtacgcttgataatttcaccttctttattattgatgttcaataccgaacatactgctacgatgttgttgatacacaccatattacccatcgcaccgcccacagattgtgcagcaagaattaggctcacagataatcctgtttccattgctgttgaaagctgtacgctaccaaaggttaagttcgatacggtatttgaacctgagaagaacgcccccacagcacctaaataagaggcgaagatagtccagtattcccctgttgcttgtgcgaaactttgaccgatgattttcaccattgaaccatcaccgcctacaagcattaagtttaccattattaacgcacccacaagcgcaaagaatgggtttttcgtttgttttaagcttgttgcgaagatctctttggtatttttcgctgatacagcaaatatagggattgcaattaatactgtaatcacaaacgggattaatgctggcacataaagcaatttgtagtttgagctaattgttgtgccgaaaatttcttttaagctgaaaattaacccgtggctaatatcaaatacaccaagcgaacctaattttacgctgaaccaagaagttgcatcgttcatcattgcttttaatggtaactgtttaatacgagttacaattaagatcgcaattaataaacctgttgggaataaagctttcactacttgtgcagtggttacggcattgctatcaacggtattatccactttcgctaaaccgatacctttgtttgccactaaaacagagatcaccataccgattgcaccgcccactaatgacgggaactcgtagtttaattgagcaattaggaaataagggatcacacaagcaaaaatactgatgtagataaacacgatatttttacgaatttcagaccagctcacgattaaacgcaatgccattactggaatgataaatgcggcaatagagtgaataaatgcagtgatagaaccgatttctaaaatttgctcttcacctaattgtaacgctcccataccaaaccaagtcggcgtacccaccgcaccaaatgaaaccggtacggagttcatcactaatgccaacattgccactttaagcgggtggaaaccgataccgactaaaatcggtgctgcaatcgccgcaggtgtaccgaaaccactcgctccttcaatcataaaggcaaatgcccaaccgatgatcattaactgagccacaggatttgggttgatattcgataaccatttacgcaacacatcggttgcaccagatacttctgaaaaacggttgaaaagcactgcaccgaaaatgacggtaatcggtgtttgtaccgcaatcaaggcagaagcaatattcgcactgaccgtttgaatatcggtgccgaaatagattagctggataattaacaccactaccgcaatccacggtaaagcgacataggaaggtaatgcgttgcgttttaccattaaataaatcagtaaaacgataggaaaaatactgagaaacagagccataaaacacctcaaaaaagaaaacaccataaaagtcaatattgaggctcatattctagtgaaaatttgtaaacaaaaaagcaaaatgttattaaattgtgaaataaatcacataaaaccctatcattcgttcaaaataaaaccacaattattttacaaacaatcaagagaggttattttttaatcacttattaatcattttttaacttatccaaaatcataaaccgacaacggtaactattttgctcatctatttcagaccacttctctgcaatctgttgccactgagtttcatcaaactcaaaaaaagtatcgccctctatattggcttgaatttcagtaagataaagtttatcggcaaaaggcattgtttgtttgaataactcaccaccgccgataatcattatttcatcgctattagcaaaatttttggctaattccaccgcttgttcaaggcttattgcagaataagctccatcaatagcaaaaccagagcgagaaaggataatattcgggcgtttcggcaacagcctgccgatagattcataggtttttcgccccataatcacaggtttacccaaagtattttccctaaaccacgccaaatccacaggcaaatgccacggcatcgcattgtcttttccgatcactttatttaaagttcgagctacgattacgctaattttcattctattcccgattacattttgaaataagccccattttagcagataatagcggtcactttcttttctttttttacacatcattatggcaaaaacaatcgtagtaaaactaggcactagcaccctaactcacggcactaaaagtctaagccgtccacatatgctagaaatcgtaaaacaagttgctcaactgcacgaacaaggacatcgcattattattgtaacctctggggcggttgccgctgggcgtgattacttagggcatcgtgaattgccaaaaacgttggcaaccaaacagcttctagccgcagtcggacaaagccagcttattcaagtgtgggaaagcctcttttccatttataacatcaaaatcgggcaaatgcttttaacccgtgcagatattgaaaataaagatcactttttaaatgcaagagatacgctcaccgccttgctcgatcaacaaattatcccgattatcaatgaaaatgatgcagtggcaacggcagagtttcgtatcggcgataacgataatttatcggcactcgtagcaattttatctcaagcagagttattgattttgctcaccgatcaagaagggttatacgacagtgatccacgttcaaatccaaatactaaacgcattcctgttgttgaaaaaatcacccctgaaattcgccaaatggcagggggaagtggtacaaccttaggcacaggcggtatgagtaccaaaatcaccgctgccgatattgccacccgttctggcgttgaaacagcgattgcttctggcgaacgtcctaatgtgatttttgaagtggcacaaggagcggaaattggcacacgcttcttagctcaacacgacaaaatcgaaggacgcaaacagtggctctttggtgcgccgcctgctggcacaatttatatcgatcaaggggcagaaaacgcattagtagaacagcataaatcgctcttacctactggtattgccaaaatcgaagggcaatttgcgcgtggtgaagtggcaaaaatttgtaaccttaacggcaaagtgcttgcccttggcattagtcgttataacagtgatgctctagcattaatcaaaggcaaaaaatctagcgagattgaaaccattttgggctatgaatttggttcagtagtattccaccgagatgaaatggtggtgcattattaattaatagatcgtagggggaaatatggaacttggacttgatgttgcgattatcttatttgttgcggctttcgtggctggttttattgatgccattgctggcggtggtggtttgattactattccagcgttattagcggtcggttttccccctgcggttgcgttaggcacgaataaattacaggcttgtggcggctcgttttccgcttcgctctattttgtgcgtaaaaaagcggtcgatttgaggcagatttggttgcttattttgctgacctttatcggcggttcaatcgggactattttagtgcagatgatagatgtcaatgcattaaaagttgccctcccctttctgatcttaattattggctgttattttctctttagtccaagcctaggcgatgaacaacgtcgccaaagaatgagctttccgatgttcgcttgcacggcggcaatgggaataggcttttatgatgggctattcgggcctgccacaggctctttctttacgctcgcttttgtgttattacttggttttaacctgacccaaagcgttgctcactccaaagtgttaaattttacctctaaccttgcttcgctgattttcttcatcattggcggtgcgattttatggaaaatcggttttctaatgatgattggacaatttatcggggcttcattgggggcgagaatggttgtcaccaaaggaaaacagattattcgcccgttgattgttatgatatcgtttattatggtggtaaaaatgttgtgggatcagagctattttgcttttataggataatgaatgaacaaagaaaaacgtattgaaattttaacccgtttacgcaatgagaaccctcacccaaccacagaactcaattattccaacccttttgaattattgattgcggtcattttatctgctcaagcaacggatgtgggggtcaataaagccacggcaaaactttatcctgtggcaaatacgccccaagcgattttagatttagggcttgatgggctaaaagagtatattaaaaccattgggctttataacagcaaggcggaaaacattattaaaacttgccgtgatttaattgaaaaacataatggcgaagtacctcaaacgcgtgaagaattagaagcccttgcaggtgtaggacgtaaaacggcaaatgtggtgctaaataccgcattcggtcagccgactattgccgttgatacgcatatattccgtgtttctaaccgtactaatttcgccccagggaaagatgtggttaaggtggaagaaaagttactgaaggtggtgcctgatgaatttaaggttgatgttcatcattggttgattttacacggtcgctacacctgcattgctcgcaagcctcgctgtggctcttgtattattgaagatttgtgtgagtataaagagaagacggagatttaatcggtataatgcagcagttgcataaaagtcaattcataatggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttgcctatcgcaatagagttgtcnnnnnnnnnnnnnnnnnnnnnnnnnnnnnnnnnnnnnnnnnnnnnnnnnnnnnnnnnnnnnnnnnnnnnnnnnatagtaatagaaccatgcccaaccttactctctttaccaataccaatagaaccctcgtcacttcctttactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggaataagtaatccaaatattaaacctaagcctagaacagctcctccgtagataaaatattggatcataatttcgcgagatgcgacatcttgtattgcttctaaatcacgatttttatttttaataatttctaattctcgctttagaagtgcattttgttcaagtaattcactactttgtaatgcagattgttgaactctacgttgcatttcagcggtacgttgttgccaatctctatcaatattattgagtttggtggttaattcttgaacttgttgttgtaataacggtgttaattcttttgagcttggcgtagatgttaattcagaatttaaaatccacgcttcacggtttttactatcacgaatgagagaataacgatctttggtttcgattaaggtaactttttcaccggcttgaatagaaccggaaattttgaattgatcgcctggacctttacgcaaataggtatttaaattttcagtaacgtactgtgtttgagcaaaagagggaattgatattgctaaaagcagagttgagcagaaaagagaaatatgtttttgcataaacaatccttaaaaaatcataaaagaaaagtgcgaatagccgcacttttctgaataaagtcattattctaaattaatagaaaattgcattcaaaatatagaaaattaaaattgagaagaatgcaccagcaggtaaggttacaacccaagatgcaacgatattacgaataactgttaagtttaacgctgcaataccacgagcaaaacctacgcctaataccgcacctactaaggtttgtgttgttgaaataggtaaacctgtaccagaggcaacaacaacggtcattgctgttgcaaattctgctgagaaaccacggcttggggttaggtcagtaataccagttccgatcgttcccattactttgtaacccattaccgctaaaccagcaacgatacccgttgcacctaatggtaaaatccaaggggcgagaattgatttcgcttcaatcacaccgccgttctcaacgatagatactacggcagataaaggcccaatcgcattagctacgtcgtttgaaccgtgggcaaatgccattgaacaagcggtgagtaacattagaatactgaacactttctctacgccaccaaatgctccgccttgtacacggttagcaaaagattggctacggaagtagaagaaacaagtgatgatagacgtaattgagattgcacttgaaatcactaaggtttcagtcattgtaagctgtaaaccaacgtgttttaagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattgtaacaatactcaaaatgaatgtggttaaacccatatagaatggaccatatttttgagcatttttcatcggattatcagtatcaaaaatcagtttttgtgtgctagtaaaaatagcataagcaatgatccccgatacaacaggtgtaacaaaccagctacctacgataccagacaaatcaccccaatgaaccgcttccgcaccaacggtgactaacgcaaaaccgataattgcaccgataatagagtgagtagtggatactggccagcccattttagaggcaagtaataaccaagtacctgcagcaaaaagtgccgacatcatacctagtacaagggtgtctggtctgccagagaattggtgaatatcaatgatgccacttttgatggtttcagttacttcaccgcctgctaaataagcaccagcaaattcaaaaaccattgcaactaaaattgcctgttttgcagtgatagtgcctgaacctacagaggttcccattgcatttgaaacatcgtttgcaccgataccaaatgccataaagaagccaaacactgcggtgatgaagacaatcatcgagccatattcttgaatcagttccattatttaagtcctctttcgattatgaacgagctaacattaactcaatgcgtgaaccgatacgttgtgcttgatctgcaagaactccgacccattcgataattttgtataagaacataatgtcaattggattgtattgttgttcaatcgctaacattgctcggcgtagtacgatttgaagttgatccgtatcgtcttcgataacatctaactctaaaatcatattgttcacaaaatttaattcgcgaccgcggaagcctgtttcaagtaggtgatccatttcattaattactttatcaacgtgaactgttgcatcaaggctacgggttaagaattgttggaaaataggttggatttcttcaggaatgtttaattgacgaccgattgcacgaccagaaatatctttagcatagtttgctaatttatctaactgtgtaacgagttcaagtaagtcagtacgttcaacaggcataaataaaccacgcggtgattttaaacgaatttcacgtttaagggtatctgcgcggttttctaaatcaatgacttgacgacggatatcttccgctacttcccaatttttttgaaaactcgcttcaaaaaatgggattagtaatccacaacattcagtcactttttttgagtgcttttgtaatggcttgagtggcgactgtgcgaataatcctaaaatattattctttgccataggtatatctccaataaaatttaacagcgttgatttgcacttttgcaaatcggtgtaaattttaccgtatgttttcaagaagatcacggattaatgtttaacaagcggtaatatttggtgtttttttagcaaaaatggtaaaataatcacagtgtttatctttgatagctgttacaaatcaaaatgttacccccacaaaatcctcacttttaaatttacaatatcgcttagaagtattattattcaaggcgttttgcctatgaatgaggcattcagtttatttatgttgaaattgattagagggtaggtatgcaaaacctagaaaatatcgttgctgaagcgttgcaagcggttgaaaaagccagtgatgttgcaagtcttgaagcattgcgtgttgaatattttggtaagaaaggtcattttaccttgttaatgcaaggcttgcgtgatgtgccagcagatgaacgtcctgcggtgggtgcaaaaattaatgaagcaaaacagaaagcacaagatgcgttaaatgggaaaaaagagcagttagaaacagaagagctcaatgctaaattatccagtgagagtattgatgtgagcttacctggtcgtaaaacagagttaggtggtttgcaccctgtgtcgattacaattgaacgtgtggtgaaattcttctcagaacttggctttagtgtagagaaaggtcctgaaattgaaacggattattataactttgatgcgttaaatatccctgcacatcaccctgctcgtgcagatcacgatactttctggtttgatgcagagcgtttgttgcgtacacaaacatcaggcgttcaaattcgtacgatggaaaaaatgcaaccgcctattcgcattatggcgccagggcgcgtttatcgtaacgactacgatcaaactcatacgccgatgttccatcaaattgaattgctttatgtagataaaaaagcgaactttactgagttaaaaggcttattgcacgatttcttaagagctttctttgaagaagatctgcaagtgcgtttccgtccgtcttatttcccatttacagagccgtcggcagaggtggacgtaatgggtaaaaacggtaaatggcttgaagtgttaggttgcggaatggttcacccgaatgtacttcgcaatgtgggcattgatcctgatgaatacactggttttgcggttggaatgggcgttgagcgtttgacgatgttgcgttataacgtgaccgatttacgttcattctttgaaaatgatctgcgtttcttaaagcagtttaagtaatctaatcattttgcggatatatgcagtttgcggacacacgcagtgtgtccctactatattaatggcttattttctcttgtagggacacactgcgtgtgtctatcataacaagtggtaaaatttgtagaaaacgttacaaatataggatagaaataatgaaattcagcgaaagttggttgcgtgagtgggttaatccagcgattaccaccgaacagctatgtgaccaaattactatgttaggtttagaagttgatgccgttgaagcggttgcaggtgaatttaacggtgttgtgatcggcgaagtggttgagtgcgctcagcaccctgatgccgataaattgcgtgttaccaaagtgaatgtgggtggcgaacgtttattagatatcgtttgtggcgcaccaaactgccgtcaaggtttgaaagtggcttgtgcaacagatggggcggtgttaccaggtgattttaaaattaagaaaactaaattgcgtggtcagccgtcagagggaatgctttgctcattctcagaattagggattaaagaagatcatagcggtattattgagttgccagcagatgctccagtcggtattgatttccgtgactatctcaaattaaatgacagagccattgaaattagtttaacgcctaaccgtgtggactgtttaagcattgcaggaattgcgcgtgaagttggggttgttaatcaattagcggtgaatgcacctgaaattcaagctgtgcctgcaactattgcagataaagtgacgattgaacttcaagcccctgaagcttgcccacgctatttaggtcgtgtggtgaaaaatgtgaatgtcaaagcacagtcaccattatggttgcaagaaaaattacgccgttgtggtatccgttctatcgatccgattgtggatattaccaatctgagcttactggaacttggtcagccaatgcacgcttttgatgcagcaaaaatcaacggtacaatccaagtgcgtatggcaaaagagggtgaagaactcatattgcttgatggcacgacagcaaaacttcagccaaatactttgctaattgcagaccaaaacggaccgcttgcaatggctggtatttttggtggtgaagcgagtggcgtaagtgccgaaaccaaagatgtggtgttagaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattcttcgcaccgcttgcaattacaggtcgtgcaagacaatatggcttacacacagacgcatctcatcgttttgaacgtggcgttgatccagaattaacgcgtaaagcaatggaaagagcgacagcgttactgcttgaaatttgtggcggtgaagctggtgaaatcgtagaagcggtaagttcggctcatttaccaacgtcaaaacaagtggttttacgtcgtagtaaattagatagcttactcggtcatcatattgaaacagaagccgtaactgatattttagctcgcttaggcttaaacccaagctatgcagacgagagctggacagttcaatcaccaagctggcgttttgatattgagatcgaagaagatcttgtggaagaagtggctcgtatttacggctataacagcattccaaataacgcaccgcttgctcatttacagatgaaaggcttcccagagaagattttagaagctattcgtgtgagaacggctttggtcgatagcgattatcaagaagtgataacttatagctttgttgatccaaaagtgcaagagctgttacatccaagccaagaagcgttaattctaccaaatccgatttcaagtgaaatgtcggcaatgcgtgtgtcgcttttaacaggcttacttgaaaccgttgcttataaccaaaaccgccagcaaaatcgagtgcgtatttttgaaagtggtttacgctttattcctgataccaatgcagaaaatggcatacgccaagaatttgtattaggtgcagtgattgtaggggataaacgtccagcacattgggaacataaagcagaaaacgtcgatttctttgatctaaaaggggatttagagcgtgttttatcgctaacaaatgctggcaatcgtttacgttttgttgcaaaatcatatcctgcgttccacccaggacaatctgctgctattttactcgacgatcaagagatcggttatatcggcacaattcaccctaaagttgttcaaaaactcggattgtcaggtaaacctgttgcttttgaattattgtggtctgcaattgcagagcgttcagtaccaaatgcaaaagaaatttcacgtttccctgcaaataaacgtgatattgccgtggttgtggatagcaatgtacctgcaggtgatctacttgatgtggctagacaagcaggtggagctaaacttgtggcagtgaatttatttgacgtttaccaaggcacaaatttacctgaaggtaagaaaagtttagcgatcagcttaacgattcaagacactgaaaaaactcttgaagaggaagaaattaatgcggtgcttcaagctgttctcgaaacacttgcacaacgttttaatacttatctaagagattagattttaaggataaattatggcacttaccaaaattgaaatcgcagaaaaccttgtcgaaagatgtggtttagataaacgtatcgcaaaacaatttgttgaggacttttttgaagaaattcgtcgctcgttagagagcggtgaagaggtaaaactgtcgggcttcggcaattttactgttcgtgataaaaaagctcgtccaggtcgtaatcctaaaaccggcgaagatgttgcagtgtctgctcgtcgagttgtggtttttaaagctggacaaaaattgcgtgaacgtgtcgaaaatgcgaaggtaaaagcctaaatgattattctgcgaaatcttggtatttcgcagaatatttttaaggatcaaaatgttctatcaattaataaaaaagcatttttctttatgcacaatgttgctttgtgcatttttattgtccgcttgtgtatcaaaaaccagtacagttcaagataaaagcggaaataaacataaagggcagctttcagactccatttttgtgattagcagtttaagcgaacatcaaagagagtggaaaggtacacgctaccgtctaggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccgtctaggcggtataacaaaaagcggtattgattgctctggttttgtgcaacttactttccgagagttatttggtattgatttacctcgaataacagtagatcaagcaaaagcaggcatacaaatctcaaagagtgaattacgtacgggtgatcttgtcttttttaaaactggtcgtgggccaaatggcagacatgttggcatttacgtcaaaaatgggcagtttcttcacgcttcaacaaaaggtggggtaatttattcagatattaattcaccttattggtctagaagtttttggcaagcaagaagattgtaagcctacatttaattagatgtaattcatgtttactatacatttgtttaaatgaatactgaactgacatgaagcatgaatactactaaaattagtacaggctccaaaattcggtaattatcttcaaaagattacggattttgcgatataattccctaaattctccagttgtgtgttcaaggatttaattatgtcaaacaccactcaaaaggaatcttgtattgttattgcaattgcaggggcttcagcttctggtaaaagtcttattgcttcgactatttacaaagaattgcaagcggaattggggcaagatgatattggtattatttctgaagacgcttattaccgagatcaaagccatcttgcaatggaagaacgggtaaaaaccaattacgaccacccaaactcaatggatcacgaactgttagttacccatcttaaaagcctcaaacaagggcaagctgttgatattccagaatatgattatgcagaacataatcgcaaagaaaccgtaacccacttcactcctaaaaaaatcatcattcttgaaggtattttattacttactgatgaaaaaattcgtgatgaaattaatgtgtctattttcgttgatgcccctttagatatctgttttatccgtcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatggaggagcgtggcagaacaatggaatctatcgtaaatcagtatcgtaaaacggttcgcccaatgttcttacaatttgttgaaccatctaaacagtatgcggatattattattccaaaaggcggtaaaaaccgtattgcgattaatatcttgaaagcacaaattaaacagctattaggacatagttaatatattagggggaattatgcgtttatgtgacaaagatattgaacgttatcttgatgaagggattatcagcctaacgcctcgcccatcaaatgaaaaaatcagtggagcgacgattgatgtccgtttgggtaattctttccgtgtgtttcgtgaacattcaacgccttatattgatttaagcggcccacgtgaagaaatgacggcacagcttaatcgtgtgatgagtgatgaaatcctgattgccgatgatgaagcctttttcctacaccctggggaactggctttagcaacaacgcttgaatcagtgaaactacctgccaacatagtcggctggcttgatggccgttcttctttggctcgacttgggttaatggtacacgttactgcccatcgtatcgatccaggttgggaaggcaaaatcgtacttgagttttttaatgcgggaaagttaccgcttgcattacgtcctaatatggcaattggtgcattgagctttgaaattttaagtggttacgcagaacatccatataatgctcgtaaagatgcaaaatataaaaatcagcaaagtgcggtgtttagccgaatcgataaagatgaataatcataattaacttccctacgaaaaatgcctttagtcgtcaaatactaaaggcattttgtctactatgccgcctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctatgcctcattcttgattattcattatgaatttccaaattacctgcctgcttcgcttgggcggttttggctttatcattgcgcgcttgagctatcgcatttaagtattcgcaactcacatcgcctgttatatattccccagtgaaaacagaagcgtcaaagttgtgaatatctggattttctaactgaacagacttaaagagcgccgataagtcttggaaaatcaggcgatctacaccaatcatttcagcaacttgttccacgctacgattataagcaaccagttcttcacaggttggcatatcaataccatatacatttggataacgtacttcaggggcagctgaggcaaaatagactttatttgcccccgcttgtcgagccatttcaacaatctgctctgaggtagtgccacgaacaattgaatcatcaacaagtaatacattttttcctttaaattcagaggcaatggcattcaacttgcgacggactgaattttttcgttgtgcctgccctggcataataaaggttcgagcaacgtagcgatttttcacaaacccttggcgataagtttttttcagtactgttgcaatttgtaaggcaatatcggtagaagtttcaggaatcgggataaccacatcaatatccgccagaatatctgtccactctttcgcaattttttcgcctaagaatttccccatatgtactcttgctgagtaaacagatacgccatcaataacagaatctggacgtgcgaaatagacatattcaaagatacaagggttcaatttcgggttatcggcacagattgctgagtagaattgtccatcaaaggtaatataaatggcttcgcctgcttgtacatctcgaacatattcaaagcctacaacatcaagtgcaacactttctgaagcaaacatatattctgttttgccgtcaatttctcgtttgccgagtacaagcggtcggataccgagtggatcgcgaaatgccaccattccgtgtccgataatcatcgctaaacaagcataagcccctcgaataacttggttagttttgcgaacgctttcaaagatattttcaggtgttaggggttcgtgtggatattgatcgagatagtaagcaaatatattgagtaaagattctgagtctgagtttgtattaacgtggcgtttggctaggttaaacagtaggcgttttaattctgcattgttggtgagattgccgttatgtactagggttaagccataaggggaattgacataaaaaggctgtgcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatacacttgagctgcctgcagttggataacggacgtgtcctataccaacatttccctgcaaacgtaacatatgttcttgacgaaacacatcactgactaatccatttgctttacgtaggcggaagcggttttcatcgtcaattgtgacaatccctgccgcatcttgcccccgatgttgtaataacgtaagtccgtcatataacgcctgatttacaggggtttgaccgataatcccaacaatgccgcacataattacctcttaaattagctagattttaaaaaactggaatttgcttgtaactgttcaaagaaccacttcacaatgaaatcaaagtgtggaataagttgtgattctttccataattcgctttggctaaatgccgtaaaggtatcaaggaaaaagagtatcgctgcgacaataaaaatgcctcttaatacaccaaaaccagcaccaagtacacggtctgtaccgcttaaacctgttttatcaacaagttggctgagtaatgcgttaatcactgcactgatgataagcacggcaataaataaaatcgcaatcgcaataccattacgcaaatattcggaattttggatatagacagagttgatttgtaataagtaattacttaaataaggataaaaatggctagaaaccaaaaaagctgctatccaccccacaagcgcaaagacttcactaataaagcctcgccatacactgactaataaagaaaaaacgataattccgataataatcgcatcaaccataaatacctcaatattgcctttcggcaaaacggaaactattctacaaaaaaaagaaaacgtttgcgtagtccatttttcaacacttgttgaaaaaaaatagcatacatcaaacaatataatgtgctcccaaactcactttcctactcagcatcgcctttaccacactttgtgcggctttgagagcgtggtaaatttcaataccttgataggcttgatattcaagggggcaataacgttgctctaactgcgttaagcagttcaacagttgaaccaaattcgcctctgttcgataaacattagcgtatgttgccatctgagaacgaatggtgcttaacacctcacttgccgtcagcattttatcaccctttggatttgctaacgactggaaaaactgttcaatactacgttcacacgctatatcgttggtaagcggtcggttttccgctaaattttgcaaaatccgttggattgctcgtttagcaaaaaccaaactacctccgacagaattgccacctaaacggttcgccccttcaatgcaagaagaaacttcgcctacggcaaaaagccctttcacttcactttcggcaaattcatcgatcacaataccgccgttacaactgtgagcaaatggcgtaatcgcaaccctatctcgcacaagattaatcccgacttctttctctaaccagcttaaatacacggtgtaaaattccgtttgatcctgatacagctcaggggaatagtgcagataaatgcctttttcttctgggtgttcgagcaagtgcttcatcatcaccaaatcaaactcaacgcaagggaaatcaatactaaaaggggcataatcactgcgagcagtcatcatctgttgaaactgctgtggtgaaaggtgtggaaacagatctcgcccttggctgtcagtcactttactgacatattttaaggtatgctctccaaacagcactttgtatttaggctcaacaaaagcagggataaactgaataaattctaagttagtcagccttgcccctgcttgttcagcaatggcatgggttgaaccaatcacatcggctggatagaggttatctttatacaaccctgcaattccccctgttgccaaaataatttggctggttttgcaaagcacatagcggatctcaccgcttgttttataggaaaacaacgccccttgaacttgctgattatcgctgacaatatgtaacagcgttgcatcttcatagaccgtcgtcccctgttctttgataatctgccttgctctttccgctgcttctcgccactgattaatcaaataaatcgggcgtggatatttcgcaaagcaagcggggcgattgtcattccgtttccaaggtttaaagccaatacgttctaatagctcaatcgcctgtggcgaatcttcaatataggcttgcacaattttcgggttattcattccctgtgcaacacgctcaatatcttcttgaaagcgtgctttatcttgttgctcgccagttacttgaataccaagtgttgcttttaacggaaaaaaacttgcaccactgccgataggggctttggtaattaatgtcgcttgaataccctgagccttagcttcagcacagcacgcaagccctgcgataccaccaccgacaataagaagatcggtttgtaaataaatataagtttgtttcatttaaatacagtagaattatgtggaagtcccctaccaactaaatcaatatattacgataaaatagagaggtaaaatccaccatatattttaagtaatgtaccaccatttcatctaggcggaacacctctgaatcaatttataaaaaagaaaagatatatattgtttaagtcttaattattcactacgccaaatcagcgttgccattcgccctgtgactttatctctacggtaagagaaaaattgttctgcatcgcaataggtacaataatcaccccctgcaatttccgtaattccaagtttatttaagcgttggcgagcaatctggtaaagattacctaggaacttactgctcatatattcatctgccacaaaggcttctctcgcttggggatcgaaggcacaaaattgttctatcacatcttcgccaacttggaatgcggttggaccgattgcaggaccaagccagacacaaatattctctggctcacattcaaattctgccaccgtagcttcaagcacaccatcgcataagccacgccaacctgcgtgagccgccgcaatctctttgccatctttactgcaaaaaagcacaggcaaacaatccgctgtcatcaccaaacagacttggtttgcttgattggtataaactgcatccgcttcaatgtcgttttgttcatagggcagacgtagcactcttgtactatgggtttgcgttaaatagagcggaaaatgtggcaaattgccttgttcttgcaagatttcacggttagtttgcactgattgtagatcatcggtgacgtgatcacccaaattcaagctatcaaagggagcttggcttaccccaccttctcgagtagtggtgaatgcgtgaacgaaatcaggaacagaccaagttggtagaatttttttcatcgcttattttctcacggcaatcgcttcaatctcaatgccaacatcttttggtaaacgtgcaacttcgacacaagaacgagcagggaaatttgggtgattgttttcacggaaaaaggcttcatattcggcatttactgtggcaaagtcattgagatctttcacaaatacagtggtttttacaatatctgccacagataaacccgcttgttcaatgattgctttcacattttcaagggattgacgagcttgagctttgatctctgtagggacttcgcctgtttgtggattaaccggaatttgccctgatgttagcactaaattgcctaaatcaaccgcttgtacataaggcccgattgcttttggggcattttcggtatgaataactgttgtcataaaaatctcctagtgaaataaattaaattcaacattgcgagtttgaaagtttttttgtggtttgtaaaggtgatttttattgaagattactactgtttcacttaaaattcgtactactttaatctgtacaaataggatatttattatgccacaaattgcaaatgcccttaacgatagaatgtctattcgcattagtacggaagacaagcagactttaattagagccgttgcacttacccatacgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattacggaatttgtattacaacgtattttgcctagtgccagagaaattattcagcagtatgataatcggcaattttcaccgcaagatctctcgttgattatggaattgcttgataatccgccgaaagctaatacaaaactacaacaagcggcgaaattagcaaaggaaagctatcatgaagagtaagtttattgaagagcctttaacgaagcatcatcaacgtgaagcctttgattgcggaaatctagagatgaaccgattttttaaacaatacgctcggcaatctcacgaaaaagggacatcaaaaacttacattagccgacacttagacagtcaacagattatcggattttatacaatcaccttaagtgcattagaccagcaacacttacccgaactatgcaaaaaacgttttggctaccaccctattccgctctttacattagcaagacttgcagtggatattcgctatcaaaaacaaggcattggcggaatgctgttggttaaagctctcaaacgctgtgccatcgttgccgaacaagtctggggaattgggcttctcattgaagcaaaagatgaagacatttctcgttggtatcaatcttatggtgctattccattggaaaatatgccattaaccttaattctactctttgatacaatcaaaggactttaactttttacctataatcgagaataatttatgagcattaacgttaccgaaattgttttacaccaacttcaacaaaccgcaggggaaactgctgagcttcatacggttttacgcgaagatctgcttgcgatcagccctgaagttgaacagatgatgttgcaactacatcaagcctatcaaaataaagcgaaagcctatggcatatttcaatcggaatccatttttgcacaacaattaaaccgcttgttagaaggcgaaagcgaatttctgccttttagccacagttgtgccaaaatgttagcgacagaattagtcaaatatccttttgcttcaggcggaacttttatcctttgccgttatacctttttagcgacggaatatctctttattgcattaattgatagccgtgcgtctatgttggttgatgataaactggaagtgaaacgcacggaatatctcgatattacacaatatgatattgcttgccgtatcaaccttactgaactaaaacacaatgcacaatctaaccgctatttgacctttattaaagggcgtgttgggcgtaaagttgccgacttctttatggactttttaggggctgaagaagggttaaatccgcaagtgcaaaatcaaacgttgcttcaagcggtgagtgattattgtgaacaaggcgagttagatagtaaccaaactcaagcggttaaaaaacaggtgtttgagtactgtaaagggcaaatcaatagtggggaagaaattgcaatcagcgaattatcggcttcaatgccaactttaaaagagattgattttgctgactttgctgagcaacaagagtacggtttagaagaaagtattccgcctgtgcgtaatgcgttaaaaactttaaccaaatactcaggttcaggaaaaggggtgacaatcagctttgacgctgaattattgtcccaacgtattatttgggatgaactaaatgatactttgacaatcaaaggattgcctgcaaatttacgagatcaattagaacgtaataaataatgacattttatcggcgatttcggtataatcgccaaaaattttaagaggaaggttatcgctatgaaaatgaaatcgcttgttgctgtattattacttgccttaggtgttactgcttgctctacgataaaaaaagtcgtttatcgtattgatgtgccacaaggtaactatttagagcaagaaaaaatcgatcaactgcaagttggtatgaataaagagcaggttcaatatctgcttggaacacctatgctacgagattcctttgctcaagatcgttgggattatgtgttcattttgcgtaaaggctatgaagctcctatccaaagaactatctttgtttactttgataataaaggcttagtgagcaatattgctctagataacgccactgcacagtgatacggaaattagagcaaaacaacatagtattatctcatagcaatttaataatcgtgcctaacgtctattggctaatcagaactcaaacataaatacatgaatttttatcctctattattgagctgaaagcagtattttatttttataattacctatggtttctcaaaattacctcggcgtaatgtctggcacgagccttgatggcgttgatttggcgttagtcgattttagccaaacgcccaaattaattgctgccgacttcaccccaatgcccgacacacttcgtgttgccctgtcgcagttagtcaaaaaaggggaaacaagcctacaagcattaggcgaactcgatcaccaattagccttgctctatgctgacagtattcagcgttttttagctaaacatcaactcaatgctgatgatattgtggcggtgggctgtcacgggcaaaccgtttggcattcaccaaaagggcaatatccttttacaatgcaaattggcgatatgaatttattggcggctagaacaggtataactactgttggcgattttcgccgtcgggatatggcttttggcggacaaggtgcgccgctggttcctgcctttcatcaagcggtgtttagttcccctgaacgcctaaccgttgtgctaaatatcggcgggatcagcaatatttccgtgcttaatcctaaccagcagactatcggctatgatgtcggggcgggcaataccttattagatatttggatcgaaaaacatctcggcaagcggtatgatgcgaacggcgaatgggcaaggacagggaaaattcattccgctttacttgcattgctgttagacgaaccctttttccaactgtcaccgccgaaaagcacagggcgagagctgtttaacttggaatggttggaacataaattaacccaaattaaaccgcttcctgctgaagatgtacaggcaacgctggttgaatttaccgtacaaagcatagtgcaagccttacggcaaattgaaaatccgcaggcttatccctgtgttttattggtatgcggcggcggagcgaaaaatccattgataatggaacggttacaaacccatttaaccgattggcaggtctccactacaacggaatacggcttagatgtcgattatgtggaagcggcagcatttgcgtggcttgcgtatcaaaggatacacaatctgcctgcgaatttgcctagcgtcacaggggcgacacaagcggtcagtttaggggcaatttttcccaacatataaaaggagtaacaatggcagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggagtaacaatggcagaacaagatcttctaaaaaccttagggcaattaattaccgaacagcgtaatccaaacagtatgcagattgatacactttctgcctatgaaattgtacaaatcatcaacaatgaagataaacaagtaccattggcgatcgaaaaagtattgcctcagattgcccaagccgttgagaaaattgtcgaagcctttcagcagggcgggcggctagtctatatcggcgctggcacaagcggacgacttggcgtgctagatgcgtcggaatgtccgccaacgtttggggtgtcacctgaaatggtcaaaggcattattgctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgagcgtgccttgcgacacccaatcgaaggagcggaagataacaaagaagcgggtaaacaagatctgcaagcggtcgaatttagcccaaaagatgtcttggtcggcattgctgccagcggcagaacgccttatgtgttaggcgcgttagcatacgctaaacagcttggtgcaaccacagtgtcgattgccagcaaccctaattctgcaatgagccaaattgccgatattgtgattgatactgtggtgggggcagaagttttgacggggtcgagccgaatgaaatcgggaacagcacaaaaattagtgttaaatatgcttactacggcaagtatgattttaatcggcaaatgctatcaaaatttgatggttgatgtgcaggcaagcaatcaaaaacttgtcgcccgtgctattcggattgtaatgcaagcgactgaatgttcccgtgaaattgcagaaaccaccttagccttagcggagaataatgcgaaattggcaattatgatgatcttggcggatctggataaagatggggcagagcagttgttaagtcaacagcagggaaaaatatctcgatacacaatagtgtagatagaacataatcaatgaattcttaatcatataaaataacaatgaaaacccaagtaaaacaacacctaaccgatctcgaaattgctttgcgagtacataatctctgggaagcaactccgccttccgcagaagccttagccaatgatgaacctttttgtgttagcacactctcagcaacccaatggttacaatggatattcttaccacgaatgcacgccctattagaagccaatgccgaattgccacgcaattttgctatttcgccttatctagaagaagccttgaaagatttagattatctccaagccttaaacgctcccctcgttaaacttgaaaccttgttgaaaagcgaatgaaattagagattatctatcaagatgatgaacttattgcgataaacaaacctgcaggaatgttggttcatcgaagttggcttgataaacacgaaacagtttttgcaatgcaaactttacgagatcaaattgggcaacacgtttttctgatccatcgtttagatcgaccgacttctggcgtgcttctttttgccttaaatagcgaaatggcacggacgataagccagctttttaaacaacatcaaatacaaaaaagctatttagccgttgttcgaggttatctacaaggggaagggcggattgattatcctcttaaagtgcaactcgacaaaattgcggataaattttcccaagaaaaagaggcacaagaagcgattaccgattatcgaaacattgctaccgttgaaatgccctaccctgcaggaaaatttgcaaccgcacgttatagtctggtacaactctaccccaaaacaggcaggaaacatcagcttcgtcgtcacttaaaacatctgttccacccaattatgggcgacaccaattacggagacctgcatcaaaaccgagtattaacagcaaacacaggctgtgatagacttatgctccattccaatagtttgcaatttattcacccgaaaaccttgcaaacaattgagataaaagcaccgcttgacgaacagtggaaagcactttttacgcaatttggttggaactttactaaattttattagacttatcatggttctatatggataatacactactgagtttaactcacgaacagcaacaacaagccgttcaacaaattcaacaacttatgcaacaaggtatcagcagcggcgaagcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaccccagagccccctatgatggtgctcaccacaattgactttagtggggaagtccctaagtcactaaatagcacaacatactctatcagtaataaaaaaattcaattatgctgggaagtaattaatgtaccttttactgctcaaaataaaacgactgaaatatttaatagcccagcaaaatctacaatgagggggggacaaggcgataatgtagtatcaacaaaagatgggaaaatgcatactattacaagccaaatgaaaagtgtaaataacgaattcattcgtcgttgttggaaatttgataacacggatccaattggcgactatacattagatctacaaattaatgatacaatattcccaacacaaaaattcaaaattgtgaaataacccttataggttacttcttctgctcttccgctcgtttacgtctaatctctttaggatcggcgattaacgggcggtagatctcaatgcgatcgccattttccaccatatccgttaatttcgcaggacgactaaaaacacccactttattttctcgtaagtcaatttccgtatgtttttgcaatacacccgattgcaaaatcacattttgaatggaaagtggattgtctaattccattttcttataaaaatatttttcaggataagcgtaaatcacttccaccacgattttttgcgtatcagacaccatacacctcttttgctcgctgtttaaacgcattcaccattttgagcgttaattcattgaaaattttgccaaacaccataccaatcatcgggcttgaaaattcaaattccaaatttaggctgattttgcaactctgttcatcaaagggctgaaacgtccaagcaccctttaaatatttgaacggtccatttaataactccattgtaattttttcatttggaatcatcgtgttatgagtgctaaaacgttggctaatccccaatttttgaatgactaactctgcattgagttcattgtcgcctaaacttaaggtcgttgcctcaacacagcctgataaaaactgcggatatttttcatagtcattgactagacgatacatctgttcagcactataaggcacaagagaggattgattgacagttggcatagtatttttaagtaactaaaaaatggcgatagtttaccacaattttgtatcaaccaatggaaagcaaattaaaagaaaaaaattgttgagcaaactctaccttaatttttcaatgttattagcagccttttgtaacaaaggtattttgaatagcattactatactctctttatgaaatatggtttgaacactgatgctacgaaagaaattaaatatttctgtaactactgcataatgctggtttaattaataacgccaccgcttcacaagcaatgccttcgccacgtccggtaaagcctaatttttctgtggttgtggctttgacattgacgcaagaaatatcgcagttgagatcgtcggcgatcacttgacgcatttggtcaatataaggtcgcattttcggggcttgagcgataattgtcacatcaacattccctaccacataacccgttgcttgaacttggcggtaggcttcaatcaataatttacggctgtcagcatttttgtattgcatatccgtgtcaggaaagagcttaccaatatccccaagagcagctgcgccaagcagagcatcggttaaagcgtgtagagcaacatcaccgtcactgtgggcgataaagcctgtatgatagggaacggcaacgccgcaaatcattaatggacgatcttgtccaaaagcgtgaacatcaaaaccgtgtccaattctaatcatcttattatcctcttgttagataaaattctgcgagagctaaatcttcaggacgagtgactttaaggttatcgctacgcccattaattaataacgggtggaagcctgcaaattccatcgcagaagcctcgtcagtgatggttaagccttgcttaaaagccgattgtaaagcctctttgagcaatttcgctggaaagaactgtggcgtcaaggcgtgccatagggttgaacgatcttccgtatgagcaatctgcgagccattagcccgtttcatcgtatcaattgcaggggttgctaaaattgccccttgattatcttcaatctgcaaaagtttgtctaaatctgaccgcttaagacaagggcgagccgcatcgtgaactaatgcccaagccgtatcatcnnnnnnngcattgagagcattaaataccgaattggctcgagtttcgccaccaaacacaatctgaattttgccagagttaagcagagcaatatcgccataatagcgatcctctttggataccgccacaataatttggctgatcgcagggtgttcaagaaaaggttgtagcgtatgttccaacagcgttttacccagcaaggttaaatactgtttaggcacagccacattcattcggctacctacgccagaagcaggaatgatcgcaatgatttttcgcttgctattcattaacgttgctctcttgggacgatgcgataaaacgtttcatctggtttaaccatttcacgatcaagccttgctcgttcttcaagggcattgatacccgtttttaaatcttcgatttcggcttgaataagttgattacgagcggtcagtttctgattagtttctttcagttgagtgacttcttgtttagcttgttggtattcattccaaccgttttgcccaaaccaaaacgcatactggaaaccacctaataaaagtgctaaaacgacaactaaaactcgcattcttttaccccattcaataaaaaagatgaactattctaccccgaattacaaaaaatataatctagatcaaaaaaattttttatcaattctcaaaaatttgaagtatgtaacattttttttggataattactctataatctctctggtttttaaattttaatctttaatcatatatgaggtgaatttatgttaaatcgtgttgaacaagaacttgcacttttaggcattacaaacgttaaagagattgtttataacccaagttatgaacaactctttgaagaagagatgaaacctgagttagaaggttttgaaaaaggacgtttaacgacttcaggtgcggtcgctgttgatacagggattttcacaggtcgctcaccaaaagataaattcatcgtattagatgaaaataccaaagataccgtttggtggacaagcgacgaagtgaaaaacgataacaaaccaatgagccaatcaacttggcaaagtatcaaagaacttgttaccaaccaattatcaaataaacgtctatttgttattgacgcattctgcggtgcgaacaaagacagccgtgttgcagtgcgtattgtaacagaagttgcgtggcaagcacactttgtaaaaaatatgtttatccgtccatcagaggctgaattagcgaacttcacaccagatttcgtggtaatgaatggttcaaaagtaactaacccgaactggaaagagcaaggcttaaattctgaaaatttcgtagcattcaacattactgagaaaatccaattaatcggcggtacttggtacggcggtgaaatgaaaaaaggtttgttctcattgatgaactactggttaccattaaaaggcattgcatcaatgcactgttctgcaaacgtgggtgaagatggcgatgtagcggtattcttcggtttatcaggtacaggtaaaaccacattatcaaccgatccaaaacgtaaattaatcggtgacgatgaacacggttgggacgacgatggcgtattcaactacgaaggtggttgctatgcgaaaactattaacctttcagaagaaaacgagcctgacatctatcgtgcgattaaacgtgacgcattattagaaaacgttgtagttcgtgaagatggttcaatcgatttcgcagatggttcaaaaacagaaaacactcgtgtttcttacccaatttatcacattgataacattgttgagccagtatcaaaagcaggtcacgcaacgaaagtaatcttcttaactgctgacgcattcggcgtattaccaccagtatctaaattaactccagagcaaaccaaatactacttcttatctggtttcacagcgaaattagcaggtacagagcgtggcgtaactgagccaaccccaacattctcagcctgtttcggtaaagcattcttatcattacacccaacacaatacgcagaagtgttagtaaaacgtatggaagcatcaggtgcagaagcatacttagtgaatacaggttggaacggtactggtaaacgtatctcaattaaagatactcgtggtatcattgatgcgattttagatggttctatcgaaaaagcagaaatgggttcattaccaatcttcaatttagcaattccaaaagcattacctggtgttgatcctgcgatcttagaccctcgtgatacctatgcagataaagctcaatggcaagcgaaagcggaagatctagcgggtcgtttcgtgaaaaactttgagcaatatgcaaccaacgatgaaggtaaagcattaattgcagcaggtccaaaactatagctgctttatacgtaggagttaatatcctatgttataaaaaatgaatgtaaaagggctggtgatggtatttcctgactcagccctggtttatttcgatgtaatagataaacctgatacagtaaacaataacaatcggcatagtagacaaaaaattagcggtaattagaaaaataattttaaaaccaacactttttgtctactatgccaattatttactctactacttactataagaggaagattattagaattatatagccatttttaaatccaaacattcaacttttccaaattcctcttgaagtactcccaccctgtaaaatattccattgcttgctgaggatatagcgtcgctaatttttcggctaatttcggcgattgcattagtcgccaaaagtccaccaactgttgctctaactgataacgggctttttctgataattgtgctatatcacaagcggtaagtttatcgatctcttttgcaatctgctcaggctgtccgaccaaatagcctcgctgggctttactcaagctactaaaccacattccatcttgtttaggcaatgtgtctaaaaatgcaattaaatccgctagcattccctgttttaattcaaactccacttcacaaatggcttcttccccaaaaggatttttcactttgccttgatcgagagcaatttcaatttgagccgtcggcgttgtaatcaaccatttctctcgcacaaaatcggtgctaaaggttggttgtaattgactgtctaataaatctgcttgcggaaagggtaaattaaagtgagaaactaaccgcttaaaatctggctgagcatcaggcaatgctagattatattcagggcgaatatgcaatccacctacaatttcgcctttcattttaagggttaattcatattgctgattttgatgacgaacccgtaatcccattttgttgttcgcaaaaaagagagcggggctatcataataggtatttcctaacagctcttttccttgttctaagataggttgagcatttatccactgctttaacaccggaatattttcaggcagtagcattattttaagttcaatttcgttttccataggtatattaaaaaatggaggggcgtttaaaacgccccttcgagtgataagaagttactgattattttgcggttgtgcttgtggttgtaatggcacttgaatggaagagttttgtgctttttgtttctcatcttccgttaaagtcacatttcctgcactagtacgacgttgtaactcgtgattttgcaacagcacattaatacggcgttgctgatactccaaatgttcagctgtcggctgatctttggctggcgcattatagcttacttgctgtacagaatttgagaaaggcaaggtttgcaatacaggttgctccacttgagccacttcctcactgctgttcatcatattcacaccccaaacggctaccaagcagacagaagctgcaatccccgcctgcattaacggtgttgcccagcgtttcaatttgagtaacatacctcttggtttctcactttgttgagcttcagccaccgcctcaatctcctcattttcgagcaacgcagccatttttgcagagaaatcactacccaaaatctgctcttcacttcgcatcacgctacgaatagtatggtagttcgcccacgttttttgtaactcagcactattgcataaagtttcagcgaaatcaccgctttctttatgtccgtccatataggcggaaagtgtttctttatgttgcatagataactccaaagtattttaattctgctacaaaagcggattgattttggcatcaatcgcttcccttgctctaaaaattcgggaacgaaccgtacccacaggacattgcattgtttctgcaatttcttcataactcagcccttcaagctcacgcaacgtaattgccgttttaagctcatcaggtaggttttcaattgtgtcaaacacgacacgttttaattcttcagacaacaccaaattttctggtgtatcagcctcacgcaactgcaccccaccatcataaacttctgcatcttcagctaaaatatcttctttcggtggtcgtctgcctaaggcggttaaatggttttttgccgtatttacagcaattcgataaagccaagtataaaaagcactctccccacggaaagcatttaatgaacgataggctttaataaaagtttcttgcacaatatctggaatatcgtctcttgcgatatagcgagtaagcaacccagctactctattttggtaacgcacgacgagtaaattaaacgctttcttatcaccattttgtgcacgctcaaccaattcttgatcggctctttgctcactcatcgttttgcgttctcctaacttctacgctgtttttatttttcttgaatgcacgcttgttagtgtgcgatatttctttaaagttcataaaaatagtttgattaattaaaatttgtgctaaatttgcaaaaataataaacatatcttcctatactaaaaaacaatatgcctatattcagtataataacgttcagttgtaaataataccctattttagtggagttttaaaatgataatcagtattcagcaacgtgcagaacttcaacgccgtatttggcagatcgctaatgaagtaagaggttctgtagatggttgggattttaaacaatatgtattaggcacacttttctatcgttttatcagtgaaaactttaaggcttatattgaacaaggcgatgaaagtgttaattacgctcagttttcagatgacgatcctattttagaacaaatcaaagacgatacgatcaaaagtaaaggttactttatttatcccagccaactgtttgagaatgttgttaaagatgcacacaccaatcctacattgaatatagaattggcagagatttttgcagatattgaaaattcagcgaacggttatccgtctgagcaagatattaaaggcttatttgctgattttgacacacgaagtaaccgcctaggtaataccgttgccgataaaaataaacgtttgactgctgtattaaaaggggtggaagaacttgattttgggaaatttgaagataatcacattgatcttttcggcgatgcctacgaatttttaatttcaaattatgctgctaatgcgggaaaatctggaggggagttttttacgccacaaaatgtttccaaacttattgctcagctggcattacacggacaaaaaaccgttaataaaatttatgaccctgcagcaggctctggctcattactactacaagcaaaaaagcaatttgatgatcatgtcattgaagatggctttttcgggcaagaaattaaccataccacatacaaccttgctcgtatgaacatgtttttacacaacatcaactacgataaatttgatattgctctcggcaatacactgctcgacccacaatttcaaaacgataaaccatttgatgcaatcgtatccaacccaccttactctattcgttggattggtgatgaaaatccgacattgataaatgatgaacgttttgccccagctgggattctcgcaccgaaatccaaagcagactttgcttttattttgcatgcgttaagctacctctctactcgaggacgtgcagcgattgtaacattccctggtattttctatcgtggtggagcggaacaaaaaattcgtaaataccttgtcgataataactatgtagaaaccgtgatcgcccttgctccaaatttattttacggcacatcaattgccgtgaatattttagtgctttcaaaacataaaccggataacaaaacccaatttattgatgcaagcagtctatttaagaaagaaacgaataataacgttttaacggatgagcatattgctgaaatcattaaattatttagcgaaaaaactgatgtacctcatcttgctcaatccgtcgaaaatcagaaaattgctgaaaacaaatatactctcgccgtaagttcttatgttgaacaaaaagatacacgagaagttatcgacatcacagcactaaatgctgaaattcgcaaaacaattgccaatattgaccgcttgcgtacagaaattgatgctatcatcgcagaaattgaacaataaagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagcccccaaccttgtggctccaacctcatgggttggcaaagtagggggagttattaaggcgaattgtacaactcgggatccaaaggtcaagggatattactaaagtaatgtgataagcggtcagattttagtaaaaatttgcaaaatatagaaaagtaagagatgagctttagctcatcggaaaataaaaggttaaatgatgggctaaagcctatcctacgaggtttaacatgatagaaagtcgttttattgaaaagttgttgaatggtagagaggtggaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgtacaacaagagatagtacggattctggacgcatttacctcgcttacagccgagcttacagccgagcttacctcaagacaaaaacaatatcaatattttagagataaattattgaattttgatgatatttctgatagggggggggtacgagactaaccctattaccaaagccttatggcacaataagaaagtggtgtttaaggctttgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaggaacaacaacgtatcgtaacaattttagataaatttgaaactttaaccaattctattgcagaaggtttaccaaaagagattgaattaagaagaaaacagtatgaatattacagagagaaattattaagtttttctcaatagatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaacaaccctcatcactgaaaccaatcattttatcattcttgataaatatacccagatcgaacaacctaatttaggctaccaaacagaagctgatttagagcaagagtttattgccgatttacaaaccttcaattatgaatatcgtgcagatattaccacgcctgaaagattattaggcaatgctcgtgagcaattacaacaattaaataatgtcgtttttttagatagtgaatggcaacgttttttaacggaatatttagataaaccggctgaaaatattattgataaaacgcgtaaaattcataatgactatatttatgattttgtttttgacaacggtcgcattcaaaatatctatttaattgacaaaacaaatattgcccgcaatcgtttacaagtgattaaccagtttgaacaagctggttcacatagtaatcgatatgacgttactattttagtgaatggattgcctttagtgcaagttgaactcaaaaaacgaggagtggcaattcgggaagcctttaaccaagttcatcgttatagtaaagaaagttttaataaagaaaattcgttattcaaatatctacaaatttttgttatttctaacggtacagatacgcgctattttgccaatacgaccaaacgagataaaaatagctttgactttacgatgaattgggcaaaatctgataatactttaatcaaagacttaaaagattttaccgcaacattctttcaaaaaaacaccctacttaatgtattaaccaaatattctgtgtttgataccggtaataatttattaattatgcgtccgtatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttgccgtcagtagtgtagatgcagctaagttgtattatgagagttttaaacagcaacaacaagcggtcgaaaaaccactgaaaattgcaacaatcttttcttttgccgctaatgaaacgcaagatgccataggggatatcgaagatgaaacctttgaacctaccgcaatgaatacatcggcaaaagagtttttaactacggctattcacgattacaatcagttatttaaaacaacttatagtatagaaggtaaagaatttcagaattattaccgtgatttagcgaaacgggtaaaaaatcaagatattgatttattaattgtggtcggtatgtttttaacgggatttgacgctccaacactaaatacgttatttgtcgataaaaacttacgttatcatggtttattgcaagcttactcacgcactaatcgtatttttgatgcgaccaaaacattcggaaatattgtcaccttccgtgatttagaacaagcaacgattgatacgattacgttatttggagatagcaatactcgtaatgtagttttggagaaaagctatcaagaatatatgaatggctatatcgatcaagctaccggcgaagctaaacggggttattggtcagtcgtcaaagagttgcaaactcgcttctcagatccagcaaaaattgaaacggaacaagataagaaagagtttgtgaaactttttggcgagtatcttcgccttgaaaatattttacaaaattacgatgagtttcatgcattaactcaaggtgaaaaaacgaatattattgatggagtagaagaacctagcggagcctataatgttggtacaactgtcccgacagaaagagttattcaagattaccgttcgacttataatgatattcgagattggttacgtcagcagaaaacaggcaatgataaagacaagacaacgattgattgggatgatgtagtatttgaaattgatctattgaaatcacaagaaatcaaccttgattatattttagagctagttttcgaaaatcataaaaaaacaaaagataagccaacattaattaacgaaattcgccgaattattcgctctagcgtaggaaatcgagcaaaagaaagtttgatcgttgattttattaatcaaacaaaccttgacaatattccagataaagccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatcttatgcttcttcgttaagcctgcatgatgtgataatttcttcttaagttggcatagtctgtaaaaaaaccaacacttttgtctactatacccattattttcttcttgcaattacccccaataacaataccgcactgcaaaacgcatacagcaagctattaccatattgagcaaacagcgtttgccctttcattgcaggcacgctggcagttaaggcggtggcttcaaattgtggagcttgggcggtgactttgccgtaggcatcgacaaaggcggtaatgcctgtgtttgtcgcacgaattagcggtttgcctagctctaaagctcgcattcttgccatttgaaaatgttgccaaggacctatactcgtgccaaaccacgcatcgttggaaatcgtgagaagataatcggcttggtgagctttttgattttgctgaacttgatcagtgaagataatttcgtagcaaatcgctaaattaaaggctctgttagccgcttgtagtggcgactggataaatgtcccttgcgataaatttataggtaaaacaaagacttccctcatccaatctagcaaattgccaaaaggaacatattcgccaaaagggacaaggtgatgtttattgtaacgaggcgattgttcgagcgagtagggttgctgcggattgcctagtacggtggcactgttaaatatatcttttggcgtttggtgtagcgtaccaataataatttcactgcctgttttagccccaacggtttgtaactgttgtagtaaaggttcaatttgagcttctacagcaggaattgccgactcaggcaaaacgattacctgatatttaccaagtaacggtaatatcagttgctgataggttcttacggtgtagttaaaatgggctggatcccatttcattttctgctcgatattaccttgtaccagtgccattgttgttggcggttgttgttcatcgatttcaacaaaacgaataaattgtgaaccaaaggcaagnnnnnnnnnnnnnnnnnnnnnngcacaggaagcggttggaaatgaagctttttttgcgagatcacggcagatcgctacaagataaccactgataacgattacaaaaaagctcaacccctctacacctaaaatcggtgcaattcctgcaaacgggctgtcaatttgactataaccaaattgtagccacgggaaacctgtaaaaacaacgccccgtagatattcagcagcggtgaatatgactgcaagtagccaaggattagccagtttaaaccgttgtaccagataagcgaataagccaaaatagagggctaggtaggcagagagcagtaatacggcaatatagctgacaatttcaggtacgccaccaaactggatcatactaacgtgaacccagttcaccccaatacaaaaatagctgacagcccataagaatgttccccatagggcgattttcttattgttgtgtgtagcaagccaaatcagaccgcttgcagataagaagatgataaaccaatagtcgaaaggggaataagctagggttcctattccgcctgaaactaaggcgaccgcacaagcggttaaaaatgacgatttttttacagctttcattcgtcttgtttctcttgttgcattaacgctaattgttcatcactgacagtcactcgcagttgaattaaacgacggctgtcagcagaggtgactttaaacatcattccgcctaattcgatttcttcgcctcgttttggtaaatacccaaaggcttgcattactaagccgccgacggtatccacttcttcatcatcaaattcaattgcaaattgctgattaaaacgttcaatatctgttaaggctgacacagcgtaggtgtgttgagaaagctgacgaataggttcgatttcttcttcatcaaattcatcttcaatatccccaacaatctgctcaagaatatcttcaatggtcactaagcctgaaaccgctccaaattcatcaactacaatagccatatgaaaacgttcggaacggaactcttttaacatacgatctacccgcttgctttcagggacaatcacggctgggcgtagaatttctgccatattgaatggttcagaatcggaacgtaggtatttgagcagatcttttgccagcaaaataccttcaatggtatctttaccgccatgcaccacaggaaagcgagagtgtgccgattcaataatcacatcaacacaagcctctaatggctgttcggcatcaataaatacaatttgcggacgagggatcataatatcacgcacacgcagagaggaaatttccattaccccttcaatcatctctttagtatccgtatcaattagctcattctcagcagaatcacggatcacttcgaccaaatcttcacgattttttggctcttgttgaaacaaaccgccaaacagcgactttaaaaaggacttcttgtcttgcgtatttacgctatgttgttcatcactcattttattttctcgttataagttaagcagaggaaaattatcataattccaataaaaaatcgacaacgaatggaatttctctctttctatttacacaaatttagcataggatatagcagttttttacccttatacccttttaggagattatgttatgaaattaggtaaaattgcccttgcaatgacagctctcatcgctggaacaacggcatttgcaggtacaatcacgggttcttcaaatgtaacttttcttgcttttgatggacaaaaagtaagaagaaatactaatttacaggtaaatgataccaatctacaccaagttgtagtagaaatatccagtatctatcagtctggttctgatagtgccttttttgagtctcaacctattattctcacttttgaaggaagtactgaagatattaaaatccttgcacctagtttaaatagtgaatttgatatagcacaatttaagaaatcacccagtttcaaaattgaaactgtttcaggaaaaaagctaacatataagcaagatttcctaaaaggagaaggttttatgcctaattcaaatattatcaataacttggcaaactacaatattggtgaaggtgttgctgctgtacaaaaatttgcattatcaactatgccaataacaatggcaaataataccaataaagttaataaggggaaaattgttgtgcaaggagaaaatgtcacagaacaacaacttcaatactggttccaacaagcagacaaagaaacacaaaaacgtttcttagattgggctaaaaaacagtaatctacgaagaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacgattaacttcgacaatatctgtaaaacggatttgatcgtttaaaaatgcctctactgcaatttcatttgctgcattcattgccgttgtagcatattgtccctcggcaaaagcctctatcgccaattttaagttagggtaacgagcaaaatcaggttcaataaaggtgagttcttttaatttaaaaaaatctaatggagcaacgccagcgtagatacggtttggatatgccattgtgtgagcaatcggggtccgcatatcaggattgcccatttgtgcaatgacgctaccgtcaatgtaacgtaccattgagtgaatgatagattgtgggtgaataatgatctccatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggtgaataatgatctccatttcatcagctgaggcattaaagagccaacgagcttcaatgtattccaatcctttattcatcattgtagctgagtccacagaaatctttttgcccatagaccaattagggtgtgcaacagcttgagctggggtgatttgaccaaattcattcaatggttttgtacggaaaggcccgcctgaccccgtgagaataattttacttacccctagttctgcaagcgggcagaaacctactttttcttgtgcttctggcggcaatgattgaaaaatggcgttatgttcactatcgacagggagcaatttagcacctgacttgcgagcttcatcaataaaaatttgtccgcaagtgaccaatgattctttatttgccagcaagacttttttgcctgcttgcaccgctgagagcgtcggtaataagcctgccgcgcccacaattgccgccattaccatatccacttcagggtgtgaagccagttcgtaaatcgctttttgccctgcgagaacttcgattttcaatcctaaagcggtgagattttcttttaattttgcagctgcctgttcatcatctaatgccacgaaacgcggttgatattgttggcattgttcggtaattaattcgacattttttccgccaactaaagcgaaaacttgatactgctcagggttattatcgaccacagaaagggtgctttttccgatagagcctgttgaacctaaaatgactaatttttgcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgacaaccttttcgcatcaatcacatcatcaatttgtagaatacgttttagtaacttatccaacaattccacattatttagctcaatttgaacgtccattgttgcaattaaacgttttggatcggtgcgacttgatacgcctaacacatttactttttcatttgccataataccgctaacatcacgcaataagccattgcgatcatttgcaatcacccgaatggtcaaactaaatttgcctgaagcatagctctcaccccattctgcttccaccactcgttcagggctactactgcgtaaatcaaagagctgttcgcaatcagaacggtgtatagaaatacctcgcccctgtgtgatataaccaacgatctcgtcacctggaataggctgacaacaacgggcaatgtggtgcattagatttccaactccctcaactacaacaaaaccactacggtttttctgttgctgttgagatttatttgccacctgttttaagatcgcttcatcggcttgctcagcagtggttttgatgagcttactctgcaaatagtgcattaattgatgtaaacgtatatcaccgccaccaatgcctgcataaagatcatcaatttgttttaagttgtagcgaggtaaggctaaatcctcaatctgtttttggctaaagttgaatttagccatctccgcttctaacatctctttaccaagcggaatatttttatcacggtctagctttttaaaccaagcaacaattttagatctagctcttgctgtattcacaaagccttgacttggaattaaccaatctcggcttgggtttggttttttctgcgtaataatctcaacttgatcacccatttgtaaaatataggtgaacggcacaattcgtcctgcaattttagcaccgatacaacggtgaccgatttcgctgtggattgaataagcaaaatcaagaggggtggcatttttcggtaaatcaaccacttccccttttggcgtaaagacataaacacgatcatcaaagacttgagaacgcatttcagccaccacatcgcccgaatcggcaatatctttctgccaatccagcaacttgcgtagccaaacgattttttcttcatagcctgaacgcccagccgttgcaccttctttatatttccagtgtgccgcaacgcccaattctgcatcatcgtgcattttttgcgtacgaatttgcacttcaatggttttattaccttggcccaaaacaaccgtatggatagactgatagccattaggtttaggattagcaatataatcatcaaaatgttcaggcaaatgtttataatgtgtatgtacaatgccaagagcggtataacaatcttgcaaattcggcacaatcacccgaaccgcacgcacatcaaacaactgctcaaaacgcagatgttttttctgcatttttttccagatactataaatatgtttagggcgaccataaatttgcacactctctaactcatcttgcagacaggcggtcagatcctcgacaaaatttgcaatatattgttcccgatctaaacggcgttcacctaaatcatatttcgcaatttgacgatattcctgagggtgtaaggctctgaagcagtaatcttccagctcccattttaactgcccaattcctagacgattagcgagcggtgcataaatatgagaacactcttttgcggctaataccagatcttcttcgcttaagcgttcggtatcacgcaaatagacaattcgctctgcaagtttaatcacaacacaacggaaatcgtccaccattgctaaaagcatacgacgaatattatcaatttgaagatcggaagcgtgactggcattaagttggcgaacgttatccatctccaacacacctttgacgagatttttcacatcattatcaaaatgctctttaatctgcactaaatcaatgatgttttgcttcacaagagggaaaagtaaggcagcgacaaggctatcatcgtccatattcaaactatgcaaaatttcgaccaattcaaccccaaaccacatcaagtgattttgttcaatatcgattttttcctgtgcatatcgccacgcaatcagtaattgttcaaaggtaataggagacatctgtagcccagcactccaactagccaactcaaaattgttcggatcgagccggtgtgaatggcgaatcgcaaccataagtcctccataacgcttaactgaaagggttcttgacagaatttgacaatgtaaaactgctttgaagtattataactgaaatcactccaaaatcgtggggattttttagatttacaaaattttaaaaaaatcttaccactttatacgtcataaaatgttattcacttgttataaatcaaacctattaagacaattatttgcaccaaccgcatggattgattaaaatgctccgtcttttcgggtggtttccaccttttttattctgtgggtaacaatgacaattttagcattaggtatcaatcataaaacggcatcagtgagcttgcgagaaaaagtagcgtttgtagaagacaaacgtcagcgtgcatttgagcaaattcgtgatcaaagcctagcagaaagtgttgtaattttatctacttgtaatcgtactgagctttatttccatcagcctgaagttccccctcaagaagaacaccctgataatattgcttggcgtgaacagtgttttaattggtttgctgaaattcatcaattagataaagaggaattaagcgaggcctattatttcaagcaaaaccttgaagctgctcgtcatttaatgagtgtcgcttgtggtttagactcgttaattttaggagaaccacaaattctagggcaagtgaaacaggcataccaagagagtgaagaattttatcattctcaaggaagtggcgtttccaccaatctttctcggctatttcagaaaacctttgctacagcaaagcgagtccgctctgaaactgaaatcggtagtagtgcggtatccgttgcgtatgctgcttgtggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagctcgccaaatttttgatgattttaaaaaactccgttttttattagttggtgctggtgaaactatagaactagtggctcgccatttaattaatcacggggcaaaaaatattatgattgctaaccgaactcatattcgagcagaaatgttagcggtgaaactagatattccaatgcaaattctttcgttaagtgcattgcaaatcggtttaaatcaagcagatgtagtgatttgttcaacaggtagtccagatattttgattactaaagaaatggttgaacaagcacagaaacaacgccgttttgacccaatgttattgattgatattgctgttcctcgtgatattgatgaaaaagcgggagaactagatagtatttatgcttatagtgtagatgatttacaaaatatcattcagcagaatatagctcaacgtcagcaggcagcagagcaagcgaaagaaattgttattgaggaggcaaaagatttctttgtttggttgaaacagcaacaatcaaccaatttaattaaacattatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttgaaaaagcgttgagtgccttgcaacaagggcagaattgcgaaaaagtactaaatgaattgagttataaacttacaaatcagttattacacattccaacacaagccttacaagcaatggcaaaaaatagcaatgttaaaggtctgcaaagtttttctaaagcattgaaattagaagaataactctttgttagggtactattttgccctaactctcttcatcacccgctctttattattttctccgttttcttttaaagtacgatataatgtacgtattttgcgtaagatgttcgtaaaccgattttaaatgaggttgtaatatgactcctgttgttgcccttgtgggcagacctaacgtaggaaaatctacgttatttaaccgcttaactcgcacccgtgatgcgttagtggcagatttccctggcttaacccgtgaccgtaaatatggtcacgcaaatatagctggacactattttattgtgattgacacgggcggtattgatggcactgaagaaggtgttgaagagaaaatggcagaacagtcgctgttagcgattgaagaagcagacgtagtgttatttttagttgatgctcgtgctgggttattgcctgcggacgtaggtattgcacaatatttgcgtcagcgtgataaaacaaccgtggtggttgcaaataaaacggacggtattgatgcagactctcatattgcggaattttatcagttaggtttaggtgaagtagaaccaatcgctgcggcacaagggcgtggtgtgacacaacttatcgaacaggttttaactccccttgcggaaaaattagacgcacaagcggtcgattccgatgaaaatgttgcagatgatgagcaagatgaatgggatagcgattttgactttgataacgaagaagatacggcattattagatgaagcattggaagaagatcaagaagaagctgacgataaaaacattaagattgctattgttggtcgtccaaatgtgggtaaatcgacattgactaaccgtattttgggtgaagaacgtgtagtggtttacgatatgccagggacaacgcgtgattcgatctatattcctatgaaacgtgatggtcagcaatacactatcattgatactgcgggggtgcgtaagcgtggtaaggtgcatttagcggtggagaaattctcagtgattaaaaccttacaggcgatccaagatgcgaatgtggttttactgacaattgatgctcgtgatggtgtgtctgatcaagatttatcgctattgggctttattctaaatgctgggaagtcgttggtgatcgttgtcaataaatgggacggtttatcgcaggatattaaagacaatgtgaaatcagagcttgatcgccgtttagattttattgatttttcacgagtgcattttatttctgctctgcacggtagtggcgtgggcaacttatttagctcaatccaagaagcctatcaatgtgcgacgaagaaaatgacgacatcaatgctaactcgaattttgcaattagcaacggatgatcatcagccaccgttagtaaatggccgccgtgtgaaattaaaatatgctcacccaggtggttataatccgccgatcattgtgattcacggtaatcaaatcgagaaattgcctgactcttataagcgttatttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttccgtaagagtttgaaaattattggttcgccgatccgtgtgttgttccaagaaggaaacaacccatttgctggtaagaaaaataaattaaccccaagccagttgcgtaaacgtaaacgcttgatgaaatttattaagaaaagtaaaagataagagattgacgttatgatgatgcaatattccccgcaatttaacaatgcgaaagtattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttggcgatgtgatgttagatcgctattggttcggttcgactaaccgtatttctccagaagctcccgtgcctgttgtcaaagttcaagagagagaagatagggctggcggtgcggcaaacgtggcaatgaatattgcgaacctgaacgtacctgtcactttacacggtttagtgggtaatgatgatgcagggcgtgcgttggataaactattaagcgaacatcgtattcaaaatcaatgtgttgcagtagattctcacccaacgattactaaattacgcattctttctcgtcatcagcaattattgcgtttagattttgaagaagattttcataatttagattgtcaagcgttacttgcaaaattagcagcggaaattaccgcttacggtgcgttgatcttgtcagattatggcaagggtacgcttgataccgttcagcaaatgattcaaattgcacgtcaagcgaatgtgcctgtgttaattgatccaaaaggtacagattttgagcgttatcgtggggcaacgttgcttacgccaaatatgtctgaatttgaagcggtagcagggcattgtcgtgatgaagatgaaatcgtgactaaaggcttaaaaatgatagccgattttgatttgtcggcattgctgattactcgttcagaaaaaggtatgacgttacttcgtccaaatcaagatccgttccatttaccgacgcaagcgaaagaagtttatgatgtaacaggggctggcgatacggtaattagtgtgctggcaacggcgattgcagatggtcgtcctttggaagaagcgtgctatttagcgaatgcggcggctggaattgtggtgggtaaattagggacatcaaccgttagcccaagtgaactagagcaggcaattcatcaacgtgctgaaacaggttttggggttgtgtctgaagatgaattgaaggcaattgttaaacaatcaaaaactcgtggtgaaaaaatcgtaatgactaatggttgctttgatattcttcacccaggacacatttcttaccttgaaaatgcacgtaagttaggtgatcgtttgattgttgcagtaaatacggatgaatcagtgaaacgcttaaaaggggaaagtcgtccgattaatgatttagatgcacgaatggcggtgttagctgggcttgcttcggtcgattgggttgtgccgtttggtgaagatacgccacaacgtttaattggggaaattttgcctgatttattggtaaaaggcggcgattataagccggaagagattgcaggtagccaagaagtttgggcaaatggtggcgaggttcgtgtactcaactttgaaaacggttgttcgaccacaaatgtgattaagaaaatccgatctttgtgaaccttttgctagaatagccttctaagtagcaggaattttttatctacaatattcataggaaattaaaatgaagtttacacaagtaaaatcattatttatcgcaggttttgctttatttgcattttcttcagctaatgcggaagagagagtcgttgcaacagtagatggttatcccattatgcagagtcaagtaaaacaggctttgggtaaaaaagcgaatacggaagctaatcgtaaagcggctttggagactattattgatgatttcgttgtgcaacgtgcgattaaagaatctggtataaaagtagactatgcttatgttgatcagatgatggaagatgttgctgctcaaaatggtataacatatggccaactacttgatgctttggattatcagggcattagtcttagtcagtatcgtcaacaacttgctcatcagcttttaatagaacaagttcggcaacaaagtattggaaattctattcaagtagagccgaaagatgttcaatctttagcgaaggatatgctagataaagcaaaaacaaacggtacatttgaaacagtttccgctacagaatatcgcattagtcacatattgattaaaacgacgccaatcttaaatgatatgcaagctaaggcaaaattactatcaattaccgctgacattaaatctggtaaaataacatttgaagaagcagcgaaaattaactctgtagattatatatctggtattgatgggggagatctcggttttaattttctagatgtctatgattcaacttttgctaacattgcaagtaaaagtaaaattgatgtgatttcatctccttttaaatcacaatttggttggcatatactaaaagttactgatactcgcagaggagatcgtacggaagatgcttatttacagaaagcttacgagcagcttgttgataaacaagtgaaagtggcatcaaaagattggataaaagtattgagaagtaaattagatataaaatatttttaatttatctaataattaagggagcctcgcatatgcgaggttctttactttattaaatttataaaaattagtgggaacataaccgcttattaaggtattcaatgagttcaaattcaaaaaaacatttagggcataccgctcgtaaacgctttggtcaaaactttttacacgaccaaaacgttattcataatattgttgcggcaattaatccgcagcaaaatcaatttttattggaaattggcccaggcttgggggcattaactgagccagtggcagatctcgtagatcatcttactgtggtcgaattagaccgtgatcttgcagaacgtttacgccatcacccgtttttacatcaaaaattaactgtgattgaacaagatgcgttgcgttttgatttccgtgcctattttgatagcctagccttgaatggcaaagcggtcaaagtgtttggtaacttaccttacaacatttcaactccgttgatgttccatctctttaagttccaagacttaattcaagatatgcactttatgttgcaaaaagaggtggttaagcgtttatgtgctgcaccaaatagcaaagcctacgggcgtttaaccattatggcgcaatattattgtcaagtaatgcccgtgttggaagtgccgccaacagcattcaaacctgctccgaaagtagattctgcggtagtgcggttagtgccatataaaacactaccctaccctgtgaaagatatttactggctaaatcgtgtgaccacacaagcctttaatcaacgtcgtaaaacattacgcaacgcacttgctacgctgtttaatgtagagcagttagaggcattaggggtagatttgaatgcacgagcggaaaacttatcgcttgcggattatgcccgtttagcaaattggttatgtgataatccaccagaaatagaaaaaaaaagaactagtcttgtttgatgaataataaaagttagtcccttctattgtcggaagttaagtcaatattcaggtgctagtatattgatcatagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtattccagatgtgtaataagtccaaattttaattggatctaatttatttttttaagataaaaattttataacatttattaccaaataacattggatattattttgtatactatgtttccttaattttcaaactttgacaaaatgggagattttttgctcatgttttaaaataggggctaaagccttgtaatataaggcttaggccactttttagcaattatgttgttttatatgaaaaattattcttcaaatggtgcattaaatctttcaattctagcacctaatttttgtagtttatcttcaatatgttcatatccacggtcgatatggtaaatacgatcaacaatagtttgaccgtttgcaatacaacctgccagaaccaaactgatagaagctcgtaggtctgttgccattacttctgtgcctgaaaggttttcgacaccgtgacagatcgctgtgttaccttcaatttctgcttttgctcccatacggattagctctggaatgtgcataaagcggttttcaaagatcgtttcggtaattttgctggtgccatttgcaacgacatttaatagtgtaaactgggcctgcatatccgttgggaagcctgggtgaggcattgtgcggatattgactgcttttggtcgcatacctagcgagtcgagggtaatgctgttttcggtcacgtccacttgcattcctgcttcacgcaatttttcaattacggcatctaatgtatccgctttcgtgcctcgacaagtaattcgtccgcctgagattgcggctgcaacgaggaatgtgcctgtttcgatacgatctgggacaatgtggtgttcacagccacctaaacgctctaccccctcaattgtgattgtgtctgtgcctgcccctgtaatttttgctcccattttgttgaggaaaatggcggtatcaacaatttcaggttcacgagcggcattttcaatagtggttgtgccttttgcaagggttgccgccatcatcacagataatgttgcaccaacgctaactttatccatcagaatacgagcccctgttaagcgaccgttcacttctgctttaacgtaaccttcatcaagggtgatagtcgcacccattttttctaagcctgcaatgtgcatatcgacaggtctagccccgatggtacagccacctggtaatgaaacttgaccttgatggaaacgagccacaagaggggctaatgcccaaattgaagctcgcattgttttgacaagttcataaggtgcaacataatggtcgattttgctggcatcaatatgtactgcgttattttctgcacgttcaacgacaacacctagtttgcgtagaatcttgacggtggtttcgacatcttttaagttagggacgttcgttaaaataacgggttcttccgctaaaatagccgcaaataaaatcggtaatgctgcatttttggcacctgaaatatcaacagttccgcttaaagtgaaaggaccgtgaacacgaaatttttccattttaattcctttagatgatgtgattagcttggcatattgagcaaacgctctcttttccattgttctttagtgaatgttttgattgttaatgcgtggattgcattggttgcaaaaaattcagttaaaggaccatagatcatctgttgttgttttactttagacattgtggcaaagctgtcgcttactgcgataacaccataatgggaattttcaccttgtacataaacttcatcaagttctaaggcgttttttaggatttcttcaatttgtttgggttccattgttatttcttctcacaaaatagaaattttttaaaccagcctgctaaatcaaatagctctgcaaggctgtgtaccgcttgcggaacattaaataaacagtttttatttttttgttgatagaggtgaagtagttcagccagtaaggtaaagcctgaggaatcaatgctagtgagaccttttaaatcccaataaatgtgctgcgagcttttgggagataaaaaagaagcacgttgcttccaaagtggaagcaacgtgtcacgggtaagctcgccagatagttgaaccatcagactttcattgttttgctgaatatgccattgtaatggattttttgtttgcatacccgaattattttaatgtgataggttgttttgcagattgtgcaacctgagctgttaaagcgtcaattccttgttggcgtaaaataccgctccattcgttttgtttggttgcgaccatactcacaccttcggctgccatatcgtaggcttgccattcacctgttttgctatttttacgccatttgaaatctaatttgattggctgggcgttgcctgattgtaggacattgacacgaatactgacgatagatttgttgtctagcggtttttcgctttcaatttgaacttgttgatcgctgtattgggtcaatacttgcgcgtaagattgctcaataaattgaccaaatgcagtgaaaaaagcttcacgctgaacatcagtcgctgacgctaaatttttacctaaaactaattgaccagcatatttaacgtgaatatgtggcataagatcattacgaacgatagtgcgtaaatagtttggatctttcttaattttgctttgatttgctttgatatcaccaaaaagtttatctgccgtttgttgcattaagacataagggctagtagaagccaaagccgagtttgaaacgaatgcagaaattgcaacaaagcctgcaataaaaaggtttttaagggttttgatcatcataaaactccaaaatgtgattttaaaagtgagcaattattccgctttaggttcagcggtgtcttccgttttgtcagatttcttatcgccatataagaactgaccgattaaatcttccagtaccattgctgagttggtatcagcaaagctatccccctctttgagcattgctgtttcgccttcaaggacaaagcccacattcagtgcaatgtactgctcgcccagtaagcctgctgttttaatagaaagagaacttgtatcaggaatttgattaaattcttcattaatagcaagggtgactttcggggtataggttttaggatcgagttgaatatcagatactcgtccaattactacaccgccaactttaattggcgcacggacttttagtccgccaatgttatcaaaagttgcatagagtgagtagcttttttccgaagagaagccttgtacgttagcaactcgtaagcccaaaaagactaaagctcctaatccaagaagtacaaataagcctacccaaaattcatatttaattgattgacgcataatttttcctattcaaatacactaacaagcggtgtattttgtctgctattttacaataatacctttgcttgtttaaccgccgaacattattgccgttaaaataaaatcaagccctaaaataaccagtgaagcgtgaacgacggttcttgttgttgcttggctaatcccctctgaggttggtagggcatcatagccattaaatagagctatccagaccactgcaaaggcaaagacgatacttttaatgaagccattaagcagatcgctcattgttacggtactttgcattactgaccaaaagctacctgcatcgacccctttccaatctacgccaacaagtgagccaccccaaataccgatagcagtaaaaatcaccactaaaatcggcattgcaataatgcccgcccaaaaacgtggtgcgataacacggcgtagcggatcgactgccatcatttctaaacttgagagctgttctgttgctttcatcaagccaatttctgcagtgagggcagagccagctcgcccagcaaagagcaatgcggtgacgacagggccgagttcacgcaagagcgagagagaaacgagctgtcctaagctggtttctgccgagaaatcgactaagacgacatatccttgtaaacctagcaccattccgataaataagcctgatagcataataatcagtaaggattgtacgcccaaaacgtgtaactgtttgataaataaaggggtatgtttacgaaattctggcttaccgactaaagccccccacaacataaaggtggctcgtcccattgctctaatcgcctgaataacggaagcacctattgaggatataaactccatcattgaaatagctcctccgtataattttgagcaggatagtggaactgcactggtccatcggctgttcctgataagaattgaaccacttgtggatcttgacttgctaataagctttcaggtgttccttcggcaataatgcgtttattcgcaataatataggcgtaatcggcaatacttagcacttcattcacatcgtgtgaaacgacgattgaggttagattgagtgcttgattgagctttttgattaattcaacgataacgcccatactgatcggatcttgccctgtaaaaggttcatcatacataataagatcgggatctagggcaatcgctcgtgctaatgccgcacggcgagccataccgccagataattccgaaggcattagctgtgccgcccctcgtagccctacggcttcaagtttcattaaaactaatttacggattaattcttcgggcaagttggtgtgttcacgaatagggaaagcaacgttgtcaaaagttgagagatcggtaaataacgcaccagattgaaacaacattcccattctctgacgaagttgatataacgttttattgtttgcttggcaaacatcttgtccatcaaagagaatttcgccgctttcaggtaaaatttgcccaccgataaggcgtagcaaggtggtcttgccgatccctgatggccccataatcgctgtgattttgcctttttggacttgtagatttaggttgtcgtaaataactcgctcacctcgtttaaaggtgagtttttttacttcaaccaaattttttatctcacgcattcgctttcttctggtttaaaaatacgataccctttgaaaattaaagggggtattgactgaaaaatggcttgtgataattaatgaatgagcaattaaagtcaatgttctttaaagtaattgacaaaattccgtttacaaaaaagcatatcggctccaagaataccaatatgcttaatgtttattatcaatgcccttattgtatgtaggtaaacactttaacgactttgacgacaccatcgacgtgacgagcaacattggcagcggcatctgcttgactacttgataaattacccattaagaatacttcaccattttcagtaatcaccttgacatctgttgctttaacagagccgttcacaaagagttttgatttaatttttgtggtaatccagctatctttgctaatttgtgcaaccccaattttagggccgatacgaacttcgttataaaccgtagatacgccttctacccctgtagcgatactactcgccgagtctttggaaaaatcattagggacttgacctatcagcaggactttgccgttataagaaacgacattgatacgagcttcgctgttaagttgttgatctttattcagattataagccactttttcttccagtgtttcatcatctaactgacgacctgccgttcttggatccgttgcaaccttcgttgcgaccgctgctccacctacaacagcagtggctaaacaaccttgtaatgatagaaatgttaagccaaataggcttgcaagggtaatgcgtttaacgagttttaacatagtcctctcctatttcaatgttagtgtgatgtagttggaaacagcagattatccaccagctcacagattaaattcacgcaaaattgatgtccttcaataattcgcatttcattaattgatggcatctcaatatccagatcggtattatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcaagcagtccttttgtatgatcatttagactactggtaaacgcaaaaatttccaaattttcgttatttgcacaatgtatcgcatttaagaccgcttgttcgttgcctagtggagaaaatgcaataaacagatctccctcttttgcaatcacttgtagctgtttacgaaagatttcattgagatcttgatcttggtttaaacagcccacgagcattccatcaaattgcagtaaatgtgccgataagctaggtcttacaagatcatatcggtgtaacaaattactcaccagcaattgtgcattggcataagagcgtccatagccacaaacgatcactttattgcctcgcaacaaacaagctacgatacgattagccgcttcgtttaatacttttggcagtaattccgctgcggcaatctgaatttgaatactttcactaaagcgatcttgaattttttctaacatactatcctaaaaaatttttgatccaaataggtgaacaatcaccttcaaatgccacaacatcaaaacgacaatttgccgtatctaaagattgatttcgttgtgcaagccataaatttgctgctttttgccatttctgctgcttgcgaaaatcaatactttctaccgcagagccaaaataggcatttttgcgttggcgaacttcgacaaaaatcaaggtatcgccctcttgcataattaaatccagttcgccacatttgaactgctgattttgggcaataaaccgcaagccattcttttctaagaaaattttggcttgctgttcaaaatatgcaccttgtgaacgcatattagtttgcatcaacaatagaaccgccacgatattgtagccagttcatttcacgctcaatattacaatttgggcctgcactcagtacgcccgttaatccgtgaactttgtaacctggaatttgacggaattcgttgaatttattcgcaatagaccaagtgtcagatcccattgcgtataaacgcatcattgaaaaatcgctctctgcaatttgctctgcttttttatattcgctagatgaaggatcggataagagtggaatttcactaaatttcaccccatccatcgttaaacggaaatcaggcccattgttcggcgaattactacgcgaagaagtataaattgggaactgattagcaagcggtgagttatctaaactttgtttcaaatcagataattgctccgctgttcctaatgcatacaaaccactaccttgtccaatacctgaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttcaaacgcttgattgtaataacgaatgtccgtatctctgttagtaagctgacgccaacgctgggcaaaggcttccgcagaacgtgtaccaaaatcgccatttggtgcaaccacaactgcattttgtaagccatctttcaggaaacgttcagctgcaaaacgagcttctgcttctggtgataaaccgtagtagcatactttggcgacagctcttacgtttggggtagaatttaatgcaagtacgttaatattgctaatttcaggactaattagcatttcatctactcttggttttaacaatggaccgataatagtttgagccccttgttgcttcgcctgcattaataaatcattaataggagcactatcagtatcaaatacctgaacttgcatggttgttgtgcccttagcatcgtcaaaaccacgcttgatgatttcccctaaaatttttgcatcaccacttaaaggcaataataatgccacgccatttaattgtgtttgttcgaaagaagatacgttgcgtaattcaatcggaagnnnnnnnnnngctgaatgattagggtactgttgcttccacatttcaatcacttgaggcaattgtgctggattagacatattttgattataagcaaccactaaggctaaccaaccagctaatccgatttcaccaggacctgccaccgctttttctaacataccacggttagcattgcgtaacatctcccaaattttgtcgttattcgcttggcgactttgagtatccgtcatatagcgatccatcaatgctcttgcattaactgccgcaatgacatcattttgattttcagcaatacgggcttgagtttgatacacacgcagacgttgagattggcttaatagtgtttgtggtaaagctctcaatacaccttgagcctctgaattgttcccttgtaatgcagctaattgagcaattaaaagacgatgttcaagtttttgctcatcgtttagtttagctaccaaaatctctgaaaaggtattctgagcttcaacaaccttattttcttcaattaacttgcgaacagctaacaaacgataactttgctgttcctcaatattgcggctctgttcggctttattgatataaaattcagagttaccataagcctcgttttttaatgtttcagtcactttattacctgaacaggctgccaacaacaaagcaagggcagtaggaataaagatcgttttcattttttggcgaaagccataactttgtactaaaatagttggcatattattgctccataaatttggctattatctagacttaagttagtctgtgaatattaggcagatcttacttatcaactaagcgaaaatcaaatgaaaaacgaatactcacctaaacaaatcggtacattatatattgttgcaaccccaatcggaaatttagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatttagaggacattactcagcgagccttaaatacttttgctgccgtcgatcttattgcagcagaagatacccgccatagcggtattctgttaagccattatggtataaaaaaacctttcttcgcactgcacgaccataacgaacaacaacgtgccaccgtgcttgtcgaaaaattacaacaagggcaaaacatcgccttaatttctgatgccggcacgccattaatcagcgatcctggtttccatctcgttcgccattgccgtcaagctggcattaacattgtaccaatcccaggggcttgtgctgcaattaccgcactttgcagttcgggtatcgcatctgaccgcttttgttttgaagggttcctaccagcaaaaagtaaagctcgttgtgacaaatttaacgaattagccacagagcctcgcacactcattttctatgagtccacccatcgcattttagactgcttaacggatatgcaaagcgtgtttggtggagaacgctatgttgtaatggcaagagagctaaccaaaacttgggaaactattcacggtgacccgcttgcacaattaatcgactggctacaacaagatagcaatcgtattaaaggcgaaatcgtcttaatcgttgaagggaaaactgcagatgaaagcgaagaattttctccgcaagcacttaaattactctccctattaagtgaagaattaccactgaaaaaagcggccgcaattgttgcaggcacttttggctacaaaaaaaatgcactttatcaatatgggttagagcattttaaataaaaaagagtgcttttatttaagcaataaaaataattcctatccaattgttttaaaaagaaattattttcattaaactgattgattttttctattatatgaataaattatattcatttattcaattatttttttaggctataatccgcctcgcgaatcacattatataggagaaaaaaatggtaaactctatcggtttagacaaggtgtctgctgagaaattagcaaaagagttaaatggcttattagcaagctaccaagtgttttacaccaatgtgcgtggttatcactggaatatcaaaggtgtaagtttctttgaattacacgcaaaatttgaagaaatctacgacgacttagtagttaaagtagatgaaatcgcagagcgtattttaaccttaggttatacgccagataacgcatttagccaatacttacaagtttcacttgttaaagaagacatcggtgcaagttcagcacaacattgcttaactggtactttagaaggcttcaaaactctacttaaacaacagcgtgaaattttagcgttagcaaatgaagcagaagatgaaggtacagcctcacaaatgagtgactatatcaaagaacaagagaaacttgtttggatgttctcatcagcagcaacttgcggtgtttgccaacagtaatttaaaatctcaaaaagacctctttggtagtaaaaccacagaggtctttttattttctatagaaatcggcacagtaggcaaaagtattagttttaatcatgttctctaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatgttctctaattctctccaatacttttgtctccacttctttgtatagctgaaaaacaggtagaatattactaataaataaccacgaatttctcttattaaaacaaactctgctgtccactcaaaaactcaggtgtctcttttgctttaaatccatagctcgccaaatagcctttcagactttcgatattgtagaacgaatggctattggtggtgttttgaaaatagagataaagctgatcaaactccgcttttcgctgatttaacaatgttgccagttgttgtaattcggtttcgctataacgataatcgtggcgttcttgtgccgattgggctttccaccagtggggattgcgaccgtgtaatcgtaggtaagcggtgcgttggttcgcataaaactgaaaggcaggcaaaccgatattctgcggataatccacgttacaccaaatcaaattttccttgccgtgaaaatagtctagcaccgactgcgtatgccaactggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccaactggtatggcgaaattcaatcgcaaggggataatcactgaaccatgacaccagctccgccagatagtaacgattggcgtactgacgctcgaaactgattgggaattgcacaaataaattggctaaacaatggctatcacacaacggttgtaacgcagccaaaaatgcctgtgcttgctctgcggtagcggtacgtttatggctaaaatcttgatgcagtttcaccgaaaattttaatctcccttcagacttttctagcataccttgcactgccttatagccaatcggggcgtgaaaggtgctgttgatctcaacggtatcgtaatgctggctgtaaaccgacaaaaaatccgttttgtccgtcccaaacggatagagcgtaccgactaaatccgtatcgctataaccgcccgtaccgatgtagatgtggggtgtgttcattaggatgtaagccacttctattcaactcatgtctactataatattaaaaacgcagtggaaatcccactgcgtttaacttattgatctaattgaaattaaaatttccaatctaaccctaaatttatttgataactttgtttatagccattaccaaataatttatctgcatcaagatataaatgggtattattgcctagacgagctttcatacctaatcctaaagttgtccaagttccacgatgattgatattatgttgaaccctgtctgtggcactacgaatgatatgaatatcttgtgtagcgttaaattctctatgcattgcgactttagtatagaaattcaaagtttgattgagttgatattgtgctttagctccaatactaccaactaagctgttgatttcgtcagccgttacattcaagccatttctaatatagttcgtagaacttaggtgagtatagaataactgcgtatatggtttgacttcccagcggttactcaattcaaaacctttactataagccagtgatgcagaatagagattgtgatgatacgcctgcgaagcattggattttagttcattagatgctcttgccattctcactgcgacatctaaataatggcgatcttctgtttcgtaagcaccatataacgccataccgtatgtttgggttttatatgtttcagagaattgagcaaagttagccttgcctttttcaacatctaaagcgaagccaaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagctgtgccattatccaacgccgaggatttatcataacctacttgtaatccaaaattgttgaatttatatagatcctgcgttattcgatcagaacttgaattaacccataacctacctagctcagaaaccgtcgggatcatgccgtttaccgttgcagttaaatacggataagcattacttgaacggctgtgttctagtctgtttcggatagaatttaatgcaaagttagatacaacggtggcataacgactttccgcaatcgctcgctgtgtttcctgttctgccgtggtgattgtgattttattgtggtttgtagatgtactcgacgttgtcgcttgttcacttgttggagcttccgttgtcggagttgttacgactgttggttgtgttggtgtagatgttgcagtgtcagagctagaagcctccgcttgatcgtctgtttgagctgtatctgttggcgatgttgtatctgacgaaccagcctgttcacctgttgttgctggtgtgctatccgtaggtttagcagggggtacatcagtattactgctgttagtcgctgtattttctgatacaggttgagttacttctgtttttagcttcacaacatagctgccattttctcctactaaagtgctgccattaggaagactaacgttattatctttatcttctgtattaatagtcaattcaccagtaatattaccattaatcaaaagagcattgtcccgaacgatagtgatattactattattaccattggtatggatattatttaacatcaaactagtcttagcgatgtcaccaaaagcatctttactcgccactgtagtgattgcggattgattattcagagttaaggtttctgaaacagataaattcttatccaaagtaatacggctattatttaatgttaaatctttaacatcttgtaaagtgatagcagtttcaggattgatgttatttaacgtaacagaaacatttgtagcttctcccgtataaattttagttacagaatttgatgaactagtaaaatgaatagctctattatgtgcttgatcattatttactccagctaaatatattgcatcaactaatccaacatgttcccctaattgtatgtttacaggagagtcatcagaactattttccgtattatcgctaatgattaccgaatataatttagtttctgctgaatttgaagtaacaataagggtattatgtccattattgcttttagtagcatcagcattcccgagccaaataattgggcgagtatctgaaggttcgctatcaacattcgttgtcacattatctaatgtcaatttattgccatttgtcacaatataggttggtttcgcttccaaattatccattttaaatccagaactaaaaatattgtttaaatctcgactaggttttaaggataaatttacattcgaaaaagtaacatcttgtcctaaggacaaattataaccttcaaggtgtaagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttccttgtccatcaattgttacttgtttatcaacattgaaaaaaccacttccacgcaataattgagtatctccgtctaagcgaattgtatcgccatctttggcttggttaagtaaacgttggaattgttcgccgcgcacattgttattttcaccagtaacaatataagtttcagcattggcattagtcactgtaactgtaattggggataaacataataagatagctaacgctaaaggggattttcggaaatgcatagatgatccttaggaagatagaaaaaaacgattaattctaatgagttttaccaagagagtaaaacactatgatggctagaaattatactttttactattttgctatatgttaaagctatcaaaatacgatataaaattgataaaaccacaacaaactaatgaaattcctcgcaaaaaatgctacatttctcaggttgatttttatttatgtacggagaaacctgaatggaactgaccgctttaacagcgttatcccctattgatggtcgttatcaagataaagcgactgcacttcgccctattttcagtgaatttggcttacttaaatttcgtgttaccgtagaagttcgttggttacaaaaactggcttctcacgcacaaatcaacgaagtttcagttttatctaaagacgcaaacggttacttaaatcagattgtcgaacatttttcgattgaagatgctgagcgtattaaaacgattgagcgtaccacaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgctgagcgtattaaaacgattgagcgtaccacaaaccacgatgtcaaagccgttgagtatttcttaaaagagaaatgtgaagccttgcctgaactgcaaaaaatcaatgagtttattcactttgcttgtacttctgaagacattaacaatacttctcacgccttgatgcttaaaacggctcgtgaagaagttttattgcctgaatggaaaaaagtgattgatgctgttgtggaattggctcatcgttacaaagatattccgttactttctcgtacgcacggccagccggcaagcccaaccacgattggtaaagagatggcaaacgtggcatatcgtttgaaacgtcaatataaacagttagaaaacctagagattttggcaaaaattaacggtgcagtgggaaattataatgcgcatctatccgcttaccctgaagttgattggcacacctttagccaagagtttattcaatctttaggggtaacttggaacccatacaccactcaaattgaaccgcacgattacattgcagaattttttgattgcgtctctcgctttaatacgattgtgattgattttgaccgtgatatgtggggctatattgcgttaaatcactttaaacaacgcaccattgcaggcgaaattggttcttctacaatgccacataaagttaatccaattgactttgaaaactccgaaggcaacttgggtttagccaatgcggtgatgaaccatttagggcaaaaattgccgatttctcgttggcaacgtgatttaaccgactcaaccgtattgcgtaatttgggcgtaggtttaggttatgctttgattgcttatgcagctactttaaaaggaattagcaagttagaagtgaatgaacaacacttgcgagatgaattggatcaaaactgggaagtgttagctgagccaattcaaacggtaatgcgtcgttatggtattgaaaaaccgtatgaaaaacttaaagagctaacccgtggcaaacgtgtagatggtgaagcgatgcgtcaatttattgatggattggcattgccacaagcagagaaagatcgcttaaaacagatgacccctgcaagctatattggctatgcggtggaacttgttgaaaagctgtaaagtttcttcataatggtagggacacactgcgtgtgtcctacattttcgcttttcaaactgtatattccattcgtttcgtaaattttttgttaaaacgcaccgcttgttgtatattcacttttactttctattttcaaacaaggagctaatatgctgaatatcgtttttcttgaccgtacaggcattcctgccactcacaacattccacgtccgccttttccgcataattggattgaatacgatcgcacttctgctgaagaaacctacgagcgagcaaaagatgcggatattgtgattaccagcaaagtgttattcggacgagagttattagcgaggttgccgaaactgaagcttattgcaattacggcgacagggacaaataatgttgatctcgttgcagcaaaagaactaggcattgcggtgaaaaatgtaacgggctattccagtgtgacagtgccagaacacgttttagggatgattttttcattaaaacatagtttaatgagctaccaccgtgatcaagtcaccagcgaccgttgggcaacttgtgggcagttctgctatgtcgattatccgattaccgatgtgcgtggctccactcttggcgtgttcggcaaaggctgtttggggacggacgtcgggcgtttagcagagttagtcggcatgaaagtgctttatgcagaacataaaggtgcaacgactattcgtgatggctataccccttttgaagaggtgttaaaacaggcggatattgtcactttacattgtccattaactgaaacgacccaaaacctgattaatgcagagaccttggcattaatgaaaccgaccgcttatttaattaatacgggacgtggtcctttggtagatgaaaccgccttactagatgccctagaaaatggcaaaattgcgggagcggcattagatgtgttagtcaaagaaccgccagcgattgataatccgctcattcaagcggcaaaacgtttaccgaatttattgattacgccacacgttgcgtgggcgagtgattcagccgtgacaatcttagtcaataaagtggctcagaatattgaagaatttgtcaaaacaggcaaataatttgtaattaacttaggagtttctatgaaaaaaacagttttaacccttgctttaacagcacttttcggattttcaacttcagcgatagcaaattcagctacccaaattgaagtgaaagttcaacaacttgatttacaaaatggcaacaaagatgtgggaacggtgacgattaccgaatcgccttacggtttagtttttaccccaaatctgaaaggattgtcacacggcttacacggtttccatattcacgagaaaccaagctgtgaaccaaaagagaaagatggcaaattagtcgctggcttaggtgcaggcggtcactgggatcctaaagagacgaaaaagcacggttatccttggtctgatgaagcgcatttaggtgatttacctgcattagcggttgatcacgagggtaatgcgactaatccagttcttgcaccacgtttgaaaaagttagaagaagtgaaaggtcgttcattgatgatccacgcaggtggcgataaccattcagaccacccagcaccacttggcggtggcggagcaagaatggcttgcggtgttattaactaattttttgttgatataacagaaatctctaagacaagcgggtagattttggtagaattttaccaatttctactcgtattaattttttatgaacttaacaactcctttatttattgcctttcgctattggcgttctaaaagtggcgaccgttttggtcgattagtcacaaaccttgcaagtctaggcattgtattaggcgtgatggcacttgttatcgttctttctgtgatgaatggcttagaaaatatgcagaaacgcaatctgctttctaccttaccccatgcgattatttcacccatagatgaagcttggagcaaagaacagcagttaaatttacctgcttatgtggaaaaatctgtcccaattagccgtgcaaatgtgatgattcaaagtcagcatggcataaatgcagggcaattaattggcgttgagaaaaatagcgatgatccgttattaacggaagtaagcgatttagctgaacgcttacctgcaggcgattttaatgtattgatcggttcaaggttagccaatcagttggatctgaatgtgggagataaaatccgtttgatgatcacggaaaatagtcaatataccccatttggtcgagtgcctgttcagcgtctttttaccgtttcagatatttattattcgaataatgaagcgagtgcttataccttatttgcaaatttggcggatattgggcgtttattgcgtattgaagaaggtaagagccaaggtgttcgtttgtttttaaccgatccttttttagtcacggaattaccttcggcatttcctgcggataaatggctagtgaacgactggcgagagcaaaaaggggaatttttccaagcggtgagaatggaaaaaaatatgatggggctattaattagcctgattatcgttgtcgcaatttctaatatagtgacatcattaagtttaatggtggttgataaacaaggtgaaattgcgattttacaaacccaaggattaaccaaaggacaggtcacgcaaatcttcgtagcacaaggggctattgttggtattattggggcgtttattggcggaatatccggggttctagcaaccgcttacttaggtgatcttattcgtttcatcaacccaacagggctaatgttaccgacagaaattgcaatggaacaggtgatcatcatcgtatgttcatctattctgctctctttggcttgtactctttatcctgcttatcgagcatcaaaaatagagccggcggaagccttacgctatgagtagaaaatcgcctattcctgaaatgccttggacggcaaaacatcaatggcaacttaaacccagttcactctgcgtaatctcagtggcaaccattctaatgggaattggtgaagggctattagtactggcaaatttaggctctagcccgtggacagtcttctcacaaggggtagcattacaaacgggcttgtctatcggcacagtggttgccattatcagcgttatcgtactgctactctggatcccacttcaactacgtttcggattaggcacactactcaatattttttggatcgctctctttattgatttaaccgtacaatatgtacctgctccagaaagcctattatcacgctttattctaatgataggggctattttactgtttggcattagcacaactttctacctttcgtgccatttaggtgccggaccaagagatggattaatggtcggaatgtgccagaaatacggctggaaagtcgggatcgtccgcacaacaatcgaagtgactgtatgtgtgcttggttttatcttaggcggaacagtcggcgttagcacattgttttttgccttgtgtgtgggttggattattcaatatacggcaatggttttggattgggaaaatttaaagaaacgagttcaaagataaactctaagatctttggaatagagcctctcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtcccctactgtcatatcgttcccttaaaaagtctgttgatttgttgcatttcggcttgttcctcaaagattgctttgatttgttctttgctcttgcctaaatgctgtaatagcttttcaagggtgattttctttgctccacctttaggatcttcccattcaggcacaatgtcgggattatgcgtaagctccactaatgcgaacctatcaaaatgtccgtatttctcaaaaacactgtctaaaatatccgtatcactaagagaaagctcgccccagaaatactcatctttttcatctactatttttgcaatgcttacttgatgattttccttatcgctaatccactcttcccacgctgtttttgtatggtttaaggtttccccacgaataagatttaaggtcttagatagcacaggtccataaggtaaagagtaatattcatcacctgtaatagaatgatctctttctaaccaacttaaacgatcagataaataaagcaatttcatcaattttatgtgatgcattgttccgcctgctttatgtagcaagtatgcccctgcttgtgctgtttttaattcgttgaacattatgctttatcctgtggtatttgttacaatcgtttacgcccgtttatgattagagagttattttactgattttttaaacagtttcaaggttgtttattagactaagcaataacatttgttttgcagaaaaaagtaataaaaaagcctagctgtaaaactaggcttaaacatcatcaggctactttctttaaatgatactggggtaatgccccttgagaacactcatctataaaatccgcccacgcttgcaatatttcaaagcgttgtttgatgtagtccgctcgattgtatgccattctaattcggtcttggtttatatgtgatagagccacttcgatcagctcagggttataacctttttcattcaggtatgtgcttgcgatactgcgtaaaccgtgagctactaacttccctttataccccatacgctttatagccgcattggcggtttgcgtgttcgtgtgggtttgtgggttcttatggctagggaataaataaaccttaccgccactgaatttcttaatctctcgtaacaaggctagagcttgtcgggataatgtgattttatgctctcgtcctttatcgtcttgtttaatccccttattgatataaatcgtccatatcttttctttttcgtctatgtcttcatattttgcagtagccgcttcattcgggcgtgtcatagtaagcaactgccacaaaattaaatagcgtgtctgtagctgaatttgagccgtattcaacgtaaataaaaactcgctcagatcttcgggtttgatcgtcttaaaatgctctacagtggggctatcaaattcttttgaaatattgattaaagggttgtgttggataatttccctatgcaatgcgaacgtcattatttcattcatcttttgaatagcacgctttaacgtttccaacgtgcccttttcttgcaaaggtttgaaggcttttaaagccattggagcagagatttgcgtaatagggtatttaccaaaagctggcaatagtattcgctcaattagactttttacatctctagcgtagccctgcgagaaattagcccgtgtttgtcgccattcgtaccacgcccacgctacattctcaaaggtgttatagatttctgtctgtttggcttgctctatggcttgacggtgagtgtgtgggtctatattttgagaaagcaaagatctatattcttccctaatttcccttgctcttgccaagtttacatcaggataactccctaagcctatttcagttctattttttgtgtatggtttatagtaattaaaacgccataatttcgccccatttggctttacaagtaaaaacaagcctccgccatcagttaaaggatattttttatctttgggtttggcgtttgctatttctgtgtttgtaagtggttttgtagttctagccataactgtcaccttagtaggacggcttttgatatatgtcagagtgatcctactaaaagtctattatttccgtttacgtcgagttacattgagagaaacaaaaaagccttgaaaggttgattttcaaggcttcttgttacgttcgtttacgttggtttatgtcgatttggtggagctggggggatttgaacccccgtccgaaattactccatcttcagcactacacgtttagtctagtctttaatttcgcttacccccagcggacagacacgcaaagaataagctagtttgatttaatttagtgtttcgatcctcaaacggcggcgtccacacgatctcgttttgggtgacttatcgaactcctcgtcttacgagcggaagctgaggcgataaggctatgagcaggttattaagctgctaaagcgtattgttcgtcgtttgcgactattttttgcggtttgtttacgaggcctaccgcacctcgacgtgcaccttggacttcgctaatcccgtcgaatccaagatcagccccaaaaagtctggcgattgtaaaggaaagcggtgagatttgcaaaaaatttttgttacatatttttgaaaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgaaaactaatctactcaaaagatgaataagtagactaaacattaaaacggaaatgcattacatcgccatcctgaacgatatactctttaccttctaaacgccatttacctgcttctttcgcgccgttctcacctttgaattgaataaaatcttcataggcaatcacttccgcacggataaagccacgctcaaagtcggtatgaataaccgcagctgcttttggtgccgttgcaccaatagacaccgtccaagcacgcacttctttcacgcctgcggtaaagtaagtttgtaaattcaatagcttataacctgcacggattacacggtttagacctggttcttcaatgcctaaatcttgtaagaactcgattttttcatcatcgtcaagttcagcaatttccgcttcaatcgcagcacaaacaggcacgactaccgcattttcttttgctgcaatttcacgtacttggtctaaataagggttgttttcaaagccgtcttcattcacattagcaatgtacatggttggctttaaggttaagaagttataacctttgattgcgtgcagttcatctttatccagcacaacagagcgaatcataccgccagcttctaaagtcggtaggattttttccataattgacagctcaaatttagcgtctttatcgccacctttggctcgtttttgtaaacgttgaatagcacgttcacagctatctaaatccgctaaagctaattccgtattgatcacttcaatatcatcaagcggattgattttgccagcaacgtgtacaatatcatcgttctcaaaacaacgaacaacgtgaccaatcgcatcggtttcacgaatgttcgctaagaatttattacctaaaccttcacctttacttgccccagccactaagcctgcaatatccacaaattccattgtcgttggtaaaacacgttctggcttaacgatttccgctaacgcatctaaacgtgggtccggcataggtacaacgcctgtatttggttcaatagtacaaaacggatagtttgccgcttcgatacctgctttggttaatgcattaaaaagagttgatttacccacatttggtaaaccgacaataccacacttaaatcccattttattttcctattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaattttacgctttaaaaccattcaagcgattagtcgctttaacaattccctctttgaacagcagttccacgcaacggctggcttcatcaaccgccgcattaattaaaggttgatctgttagcgaaggtttacctaacacataacttgccaccaagtctttatgccctggatgcccaattccgatacgcacacggtagaaattattgctattaccaagagcagcaataatatcttttaaaccgttgtgtccgccgtgtccgccaccttgcttgattttggcaacacctgggggaagatctaattcatcgtgagcgactaaaatctcttcaggcttaatgcggtaaaaattcgctaacgaaccgaccgctttaccacttaaattcataaacgtggttggcacaagcaaacgaacttcgccttgtggcgtgttaattttagcgactttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgaagtatttcgcttcctcttttaaggtgacattaaacatacgagcaagctcgttcactagccattcgcctgcattgtgacgagtttcttcatattttgcaccagggttagcaagcccgacaatcaatttaatttgcgacatagtttttgttcaataaataaagggcgatattgtaggtaaaaaggggaattttcacaaggaagatgtctatattttattgtcttaagccaacattattgctctatcaataatcggaattcgtttttaatataatgtcagtttgatttatgttttgtaggcgacttgatgtgttgtattacattttattttatctttttacttaatcttatgatttgtcaatttatttatcttaaaagctctatttttgatctaaattttacatattttgaatttttaatgtggcatacttcacatttttgacatttttctttacgtttggcggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggagaatactcgcttggatacatttcatttttaacttttaaatgtgatgtatcaaacgcggtttgtttatatgttttcaagtgttatagagcagatatatgacatttgcgacggcaaatgtggtgattattggtactagagtaatttttcctgaggagcaaaagagtgtcaatgttcagttgcaaaacagtagctcagatcctgcgttagtccaatcttggttagatcgtggggatattaacagccgtccaaatagtattcaggttccatttttagtaacacctcccattgtgcgcatcgagcccaacgcaggacaaacgttgcgagtggtttttacagggaaagaaaatttgcctcaagatcgtgaaacgttattttatttgaatgtattagatgttccgcctaaacctaaagcggaggatttagggactaattatctgcaatttgctattcgttctcgtattaagtttttctatcgccctgctctctcttagcccttatgatgtttatcagtcagtgcaatggcttaagacagcgaagggggtcgttgtcgataatcagacaccttattttattacctatcaatctgttaagttgggaaatgcttatttgcctaatagcgaaatggttgcaccattttctagtaaaactttgatattaaaagggaaagttagtggtagtcgagtgaattgggaagcaattaatgattttggcggaacagaaaaaggggaagcagtgttgcgttagttcctcatgatgaaataaagagatggtgtcaaaatgaagaaaataataataaaacctgttccttttcggctggcaatgctcactgtgctgttaggcttaagccctactgttgttgcaaatgatgttaactctgttttgaataaaggggttgaagctgagttttatagtagctttttaacaatggggaaaattcagatttgattatacggtgtctaggcttcatcttgaaattccgcaaatttatgttgtacaacgtcctagaggctatatttctccacatttatggcaaacgggagtacctgttgcttttcttaattatgatttgaatagctatcaacattatggcaatacctcttataaacagcactatcttgctttgaatgggggaataaatttgggggactgggcttttcggcatgttggtgcgaaaagttgggatagttcaggagagagttcctatcatcgtattgcgacctatgtaaaacgtcccattgtgtctttgcgaagcgagcttacggtaggagattttaccacagatggggctgtcgttgaggcgatagggctacgtggcgtgcgtctggcaagtgatgatcgcatgttgccaacttccttgagaggatacgctccaactgtcagagggattgcccatagtaatgcaagagtaactattagccagaatgggcatattatccgtcaattaaatgtccctgctggtgcttttgaaatttcagatttaaacccgacaggatatagtagtgagttgcatgttgaagtgttggaagcaagcggtgacgacttttacttcttcgtatcagtaggggagagattgtagagagaagcggtgagattttataaaaaagatcccaccgcttgtattttaattaaatcttcgttttatctcttaccgcacctttatccgccgatgtcgcaaaatgtccatacacttttagtgcaaaagagacttcacgctcacggtttgcaggtttccagcctttcgcatcttgttctgctcggcgttgggcaagctcagcttcaggcacaaccagttcgattttacggtttggaatatcaatttcaatggtatcgccgtctttcactaaaccgattaaaccgcctgcggctgcttctggtgagcagtgtccgatagataagcctgatgtaccgccagagaaacgaccgtctgttaataaggcacaagccttgcctaagcccatggattttaaatagctggttggataaagcatctcttgcatacccggcccgcctttcgggccttcgtagcggataaccacaacgtgtcctgctcgcacttttccgcctaaaatccctgcaacagcatcttcttggctttcaaacacaatggcttcgcctttgaattttaagatcgcctcatctacccctgcggttttcacgatacagccgtctaaggcgatattgcccgacaacatcgctaaaccaccatcttggctgtacgcaaactctttgctgcgaatacaaccgttttgacggtcatcatcaaccgtatcccaacgggtatcttgcgagaaggctttggtggtgcgaatacctgcaggacctgcacggaagaatttatgtaccgcttcatctttggtcagcataatgtcgtacttggcaatttgttccgcaaggcttaagcctaacacggtgcgagtttgattgttcaataagcctgcacgatctagctcgcctaaaatcgccataatcccacctgcacggtgtacatcttccatatggtatttttgcgtgttcggtgcaactttacttaagcaaggcacttggcgagaaaggcgatcgatatccgccatcgtaaaatccacttccgcttcttgtgctgcggcaagtaaatgtaaaaccgtattggttgaaccgcccattgcaatatctaaactcattgcattatcgaacgctgctttggttgcaatagaacgaggcaatacagacaaatcatcttgctcataatattttttgcagagttcaacaatttgtgttcccgcatctaagaataactgtttgcgatcagcgtgggttgcaaggcaagagccgttgcccggtaaacttaaacccagtgcttcggttaaacagttcattgagtttgcggtaaacatacctgagcaagatccacaagtaggacaagcggagcgttcgatttgatcgcttacctcatcagacacattcgggttcgccccttggatcatcgcatcaaccaagtctaatttgatgatttggtcagacagcttagttttccctgcttccatcgggccaccagaaacgaaaattgtcggaatgttcaaacgtaacgctgccattaacattcccggtgtgattttgtcgcagtttgaaatacagaccatcgcatcggcacagtgagcattaaccatatattctacgctgtcggcaattaaatcacggctcggcagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagagaatagagcataccgccgtgccccatcgcaatcccatcatcaaccgcaatggtattaaactcttttgccacgccacctgctttctcaatttgctcggcaacaagttgccccatatctttcaaatgaacgtgtcctggtacgaattgggtaaatgagttcaccaccgcaataatcggcttaccaaaatcgttttctttcattcccgtcgcacgccataatgcacgtgcccctgccatattgcgaccttgtgtgctagtcgccgaacgtaatttaggcataaataatctctccaaattttgatgttgtgtttctataatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctagtaaaattattcattttatgaatcgtgaaataccgtttttgatcacttttataaaatctcaactgtcctaaaatatcttcggaaaataatatattcttcaactctttagatgctaagtatctttcaacgtcaaattgacgagtatctccagaagaatcctttactaatataggtagtgaaaatggtgaatcattcttagtaaaacagtgcaatccgtaagtaacaacgagtttataatccatttttttactatgaatgattagttcgtgtgcattaagatgactcatatcaaaagaggtattctcgaactcttgtgattcccacttctgtatggcttctatatgaaatttttttgtcattcttttttatagttcaaatattcgcttgataatattgtgtgacactttagatgttttatcaagccttttagccctttagcctttgaaggaatgcgaatggcgttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttatctaggacagccccataacttaaatactaccaccatatagcaattaaatagagttaaatggtacaggcataatttatagatctaaatgaaggtacataaatgttaaccgcacgaatttatataagagtacagtagtctgtaaaaatgtttagatttttatatatacctaaggtaccacacataaattcacgagcagataccaactctggtcttagtggagaaaggataagatcgctagcaaggactgccatatcaaccgtaatgccccgtgtacctctagtgtcaatgatgattaaatcatagccatcaattttttaacaaattgattgtatttcaggatacctccaggtgtacttgtaagatcggtagagagcttatctagtggatcgttagattggattaaatccaagttagagaattcggtccgagaaataatctcctttaatggaagatcaggacgagtgaaaaattcatacaatccaaaaggtccagaatcttcaatatgataataagacgatagggtaggttgaacatcagtgtcgatcattaaggttttaataccgtgatcagcacagaaagcacctatatttgcaacattcgttgattttgttactccacctttgaacattactgtaacaataaacggtttgatagactgtggcatacaaatctctccattttaattagtaaagaaatttgttttttttgtgcagtctaagatgatgcagtggtcggatacattcaagcaatgtaacatattgaaataaaaggttattttatatttaaaccctaaatcatacccctaaacgtacccctataataaaaaaacgcctataaatagattattatttaatcaatttttagcgactaaacactacagcattttgaagtttatcacttgtatagggttgtttttaaaattggcggatcaggtgaagaaagttcactttttactatggtgatataactatgcttcggtgtcatctcctcaaaattgaggaaatgatttaattttaggataatccatttacttaaaataacacgccttgcaattttaagagactgaagaaaaccagtatcagcaaattcaacatctaccgccatcattctaggcataactattcacttttaatcaaaagatgatgatggctagaaccccgaaaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgctcgcataattcaagtggtcggcgtgtgccttgccgtcagggaatgaatgatagactttcgcccttgtgataggcacattcaacaagcggactaattgccctgcgtttgtcttaatgcctcccatcgacaaatagccctctaggtcaatctcacccgtcgaaaatgccataatccgccaccgttgaagctctctattaccgccgtcttttgctccctgtattttccccacgccattaaataaagcgtaggcggtttgctctatgtacttgcggtttgagccttgcccgatttcatcaaggggcataaagttatcatttcttgccgatgcctcattnnnnnnnnnnnnnnnnnnnnnnttccacgataaacggattttgtcagggtgtccgtatagactgctggcaatgttagtggtggtggttttgcctgcggttgagccaccgaataagtgaactccaaagctctcagcctctatgatgttcattatcggggcagataaagcgcaagcaatacttaacatcatagagggattacctcgcacgttatcggcgatctcttgcctccagctctctattgtgcctttggtgtcgtatccactggcggtggcggattgacgattaaatagcacaggtgtttcaggttcgcctaatacctccccatttggcagaatataagccccattgtgccaccctgtagcgttggtgatgtgccatagggtacgcttaccgctactttgtaaatagtccgccaattcatttcttagataggtacgagtggttaagcgtagcccttttgctttgagctgtcgccacccctcccgctctcctaaatcccccaaggataacgcctctttgactggttgcgatttgccctcaggggtccattcaagcacgagataatgttcagcctcgctttgccctataccaaccactgcgatttcatcagaaagccattctgtacgctctgatagcagttcgcctgtgtccttgtcatatttcggggtaatgcgataaagcccctctatgccgttctctgtgcgtttttcgatataggcttgatgtttatctatgtcagcatttacatcatcgctagcggtcacttccgccacgttttctgccattgcttcaccttgtcgaatgcgttcgatatatccgcttaaatcttcaaggtgttgctcggcttcgtcaatgtagtgaatgattttagcctttgtatttttcgcaaggtttaagtaaagtttagccataatctcaccgcttacatcttcaccgtgattagctcgctgtatcgtgatgatataaacctttttaggtgctatgcggtattgatgaacgttttccaaaacctcagcagtaagcacaatagggggcgatttctcaccctgtggtaacacatcatcaagtgctatctcgtcctgtgaacgttcagctggtggagctttggcaaaatcccacgcttgagagccgataataatataagcattctccgcattaggtttttgctgtttcatatttggggcgttttttaatttcatacattccccctgcttaaaatctcgtccgttttatcaatcagttgattaattctgtgggcgtgtctttgtaatacctctaactgctccgattgttcgcctaaatgccactgaataacgtttagagcgtgctttaatacttcgcctgtgtaagcggtcggattatccgccattgcgttaatttgggcgtttatgcgtgcgtggtctatgttcattcggtctaataacgataaagggattttaatgtgctgaatgctattcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcattgctcccccttaaactgtgataaatagctttgtgtttcgtactcagtcagcattggtaaaccacatttagcacgctcaccatttagcaaggtgatagctttcaaggcttcttttgtattgggtaagcggtaaatcgtgtaagtacctgttccgtattggtttagtctttcggttttgtgaatggcgatattgtgtaatcttggtaattccgtcacctcattacgcccgctattgatgaagtatttaaagtcaatctctcgcccgctaattccttgtgggtgttctagtagtgcggtgatagattttgcttttcgggttggataaataagctgtttcataagatgttacctcgtgaatgtgccttagctgtttacatattccataatgtccgccaatctccaacgagtggaacggccacattttttaggttgtgggaaaatgccctccttgacgtatttgtaaatagtggtgactgaatgccctgtgatagctttcacttcttgaacatcaagcaattgtttttggtgggtggtttgggttgggtttaatgtttccatcttttacgctcctttgcgttgttgtttttgtattcggggcgtattgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacaagcggtcaatttccgccaaaaatctgttatttactcaatttcaaacatcattccgcattgctcgcaataatcgccaacggcttgtaatgcttgctttcgttcttccataaattgccaacggtcatagactgcttgcgttttctctttgcctattgaatggtgagctagagcaagctcagcaacaaccacgggaacgcctatgctggttaaataggttctaaatattgacctgataccgtgtgcgttttgcttgccctcgtagccgttttctcttaatgcttttgctatggtatcctttccaatggttccgctattgctttcagtactcgggaatagataacggctgtaaccgtatctttggcggattgtggctagtaaccgtgccatttgtgacgaaatcgggataatgtgatctatcggttgctctttcatcttcctagattgcttcattcgcttggctggaataattaaatactgctcgttttcatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaataggcgttattcattgccgttaatagctcaggtaattcatcgggcataatcgcagggtgattttttgccaacggtgcaacaaagtcatctttagcaatgttgcaattatggctttcgataatgcctaatttaataccgtgatccattgttgccctaatcaagcggtgcaatttgtctagcgtattacttgccccgatttgagaataaagactaaccaacaatcgaggcttgatttcttcaagtggtaaatcaccaatgatagggaaaacgtgcctttctaaccgctcccaattcttccgcctcgtttcttcattgtgggcttttaaagggtaaatatctctaaaccaacgctcacacacatttaaaaaactgttttcttgctgcagttgtttcgcttgctcttgttctttacggtgaatttgtgggtcaatccctttggaaataagcaagcggtattcatctcgtaatgctcttgcttgtgctagtgataggttttttagctcgcctaaacttaaatcagtctgcttgcctgtatttggacgaacatacctaaaccgccatattttggaaccattttttttcaccaatagaaaaagtccctttccgtccatcatcttataatcagtttcggcaggttttgcattttgtattgtggttttatgaagctctttagcaggtcttgccatacgttctacctagctttaacgtgtttttaggggtacgttccccctaaaaaaagatttaagggtataaagtggatttcatacccctaaatatacccctaaaatttgcggttgtaaatgtataaatgcgaacgaatacgaaagaatagggaaagcagaaagtagcttgaagccttgnnnnnnnnggtgatagtgtattaaaatgaacgaaaaaataagaaataaaaaaaccgctaaagagcggtttaattgtgtgttggtgccagtggtcggactcgaaccgacacgctttatgggcggcggattttgaatccgctgcgtctaccgatttcgccacactggcaagctgaatgggtgcattatagggggcttcggttaaggttgcaagcaaaaatcgtgtgatttcaatcggttgtttttattttcaacactatttcaatactaagcggtataaatgccgattaaaatcgcaatgaagatccccattcccacatagtgattatttaaaaaggctttgaaacaggcttctcgttcacgttgtttggtgagtttgcattggtagataaataaggtagcagttatccctaacgcaataaagtaagcggttgaatagtggcttatttttccaaaaatcgtgagtagggctaatgcggttgcttgcaataaggcaatgattttgttgtcgtattgagcaaataaaattgcagttgattttacaccgattcgtaaatcatcatctctatccaccattgcatattgggtgtcgtaggcaaccgtccaagcaagattagcaaaaaagagtagccaacactctaggggtaaggtttcacttaccgctccgtatgccattggaattgaccaaccaaacgccattcccagtacaaattggggtaaatgtgtgtaacgtttcataaaaggataaacagtggctaaagcaacggcaatcacagataagccgagagtataaaggtttaattgtaataccaacagaaaggcaataaaaatcagtgtggcaaagagtattttggcttcttttgctgtggctctgcctgtggcaagtggacgttgtgatgttcgttttacgttaccgtcaatgtggcgatcggcataatcgttgatgacacagcctgccgcacgcgtcacaattacgccaagtacaaagatgattaaaataggtaaaggcggaacgtcatctgccactgcaaataacgcccataaggtcggccaaagtaataaaaaagtaccgattggcttatctaaacgcattaattgcatataagccaaccatttatcttgactaaaatgtgatttcattcttatttttcgttacaaatatgcacagcgacatcactgtgaataagatggttttgcaattctattggcaatgggcgatcagtaaagagataattcacttctctgacatcacctaaacgcacaatcgcattgcgagcaaatttggaatgatcggtaacaagaaccacattgcgagcatttcgcattaacgcacgtttaacttgtacttcgtggtaatcataatccatcattgagccatcagattctaccgcactaatgcctaaaatgcagtaatctaaacgaaattgattgatgaaattgacggttgcttcgccaataataccgccatcggtgcgtaaaccgccgcctgcaattgtaatttgaaaatcttctttttctttaaggatatgagcggcgtttaaattattggtgacgattcgaaggtttttatgggaaagtagtgcaaaggcaactgcttcaggggtagtgccaatgtcaataaaaagtgaagcaccatcagggatcatctcagcgactttcattccgatacactctttttgcagagagaagaaccgtttacgttcaatgtaatcgctattttcactggtagaaggcgcacctgcaccgccgtgatgtcggcgaattaagttattttcggcaagttcattcagatcacgtcggattgtttgagagctcacattcaattgagcaacaagctcttccgtgctgacatagcctaattgattaaccaattcgataattttattgtggcgaatggactgtttcatttttattctcccaattcacatttgcaaaatttttcctaaaagtgaccgcttatgtagtgtgcccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagataaacttaattagacgtatcaatctcttcaaaagatttcacgagatcatcaatcgctttcatttgtgaaacaaaggcttctaatttagacaacggaagggctgatggaccgtcgcattttgctttgtttggatctgggtgggcttctaggaataaacctgccaaaccaatcgccatacctgcacgggcaagtttggtgacttgatcacggcgaccgcctgacgctgcgccaaatgggtcacggcattgcaatgagtgggtgacatcaaagatcactgggcaaccttttgacacttttttcattacgttaaaaccaagcatatccacgactaaattatcgtagccaaagtttgtgccacggtcacataaaatcactttatcgttaccgcactcttcgattttttctacgatatttcccatttgtcctgggcttaaaaattgtggttttttcacgttgataactgcacctgtacgtgccattgcttcgactaaatctgtttgacgagcaaggaatgcaggtagctggataatatcaaccacctctgcaacaggctggcattgatagatttcgtgtacgtcggtgatgattttgacaccgaatgtgtctttcaactcttggaaaatttttaaaccttcttccataccaggcccacgataagagtgaatagatgagcggtttgctttgtcgaatgaagccttaaagacataaggcacgcctaatctttgcgtaacttcgacatatttttcacagacttgcattgccatatcacgactttcaagtacgttcattcccccgaataatacgaaaggtttgttatttgcaatgtcgatattgccgagagagattgttttttgttgcataagaaatccttaataatttcgcaaactaaatatgatttccctctcccgtttacgggagagggtggagcaaattcgcagaatttgcggagggagagggctttgcaaatatttcaccaaatctaaccgcttgcgccctctctctgctcaaaatagcctcacgctattttgagctgtctctctcccgcaagcgggagagaatgtttgtatttaatgtaaaacactcgccttactctgtttctcaagccctgcaatttcaagttttaacatcattgcagaaggatcgtcagggcattgatcgataaaatagcttaaatcatcaaaagctgcttgatagcaatccatactcgctaaaatcattccacgatcacggatttcataaggatcttcagggctaatggtcaatcgatattcgattaaacgcagtgcttcttcatatttaccttcacgagttaaagccattttaaataccgtttctaaccgctctaatagctcatcttcttccgcaatacgcaaatactcttggtttaattctacgccgtagcccatttccccttcgagccatttttccaatttttcacggcttagctcagagccatcccacggattgataaatttcacctctgttctgccttgctcatttttcaattcagcacgcaaaattaattgcgtcgggaaattgacggggtacaagggtaaattcagcgaagccgccaaataaagcaccactgcccctaaagagaccggcattccacgaaatttacgaataaccttattaatcaataggttatctgtatagaaatactcagcgtgatgacaatgaaagccccattcttgataaaccaatctcaatagttggtgtaaacgttcttcatcgctttccccattcacatcatagcgagctctttttacaagtgccgacatcaagcctaacacctgcggttcagacaggttatcgtcaatcatcaaggttaagcgaactaactcatggtaaagaaatttctgaagctgaactttatttaccacgcttttaggctttttaatctcttggaaaatatcgttaattatgttgtccatattgctactgttactctatcattaccgccataatcttggaacgtagtgactgcattccattgattttgttggaaaatatcttgaacactcgcagcttgttgccagccgtgttctaacattaatgccccgtttggggttaaataaagcggtgcgttttggataattttttgcaaatcgctcagcccgttttgttcggcaaccagtgcggttaatggttcaaaacgaacatcaccttgtgttaaattttcatcgtctttatcaatgtaaggcggattactcacaataagatcaaagcgttgatttttcaaggcttcaaaccaatcgctttgtaaaaagcggacattttcaaatcctaatttctggcgatttttctctgccagttgcaccgcatcaggctgtttatctatcccaataatctctgctttggttcccaattcactcgctaatgctaaagcaatcgcccctgtgccagtgcctaaatctaaaatatgcaatttttcttgagtcgctaaccgcttgtatgcccattccaacgcaacttcgaccaaacgttccgtatcaggacgggggattaaagttgccattgataccgccaaaggcaacgaccaaaactctttttcgcccaagatgtatgccatcggctcacctttggatcggcgagcaagtagctcggcaagttggcgtagttcgctttcgttcagttctgtttcggcaaaagcaaaaattgcagattttgaacgttttgttaccgcttgtagcagaatgttggcatcggctttggcgtttaaaaacggatcctgtgatccgttttcaagcagggtttgttcggcaaaagtgagccattgttggtaggttttactaaaaatcttcaccacttcaaaacgttcacatacgagctcaaattcatcgctaatcggttgatttaattgttgactaaaaaaatgttgatgtaacgatttccattcatccaaagagccttcgccttctgcaattgcaaaggcttcagatactttgcctaaggtattaaaagtcacttccgtcaattttattgtcactaaaggctgattttggctatctaaaatagtatgcaattcatcttgaacaggatatttatctccattttcaagggaatagaacattttgccagagcaagtcgctgtttttttaccagccagaactaatgtggctaaataatttggtgtgatgccgaattgccattgcgagtgaatttgagccatagagaatatctcaatatgggggatgtctccccctaagaatagattaattctgatccgacaacgccgccaactgatccgcttgatattcggtaataatcggctgaattaactcatcaattttaccattcatcacttcgtctaaacggtaaacggtcaagttaatgcggtgatcggttacacgcccttgtgggtagttgtaagtacgaattttgtctgaacgatcgcctgagccaagtaggttacggcgagtatctgcctgctcttgcgcttgtttttctttctcaacttggacaatgcgtgatgcaagtaccgcaagtgctttagctttgtttttgtgttgtgaacgttcgtcttgacactccaccacaatacctgttggaatgtgggtaatacgcaccgcagagtcagtggtattcacgtgctgaccacccgcccctgatgaacggtaggtatcaatacgcagatccgcagggttaatttctggcatttcgctttctggtaactcaggcattactgcaaccgtacaagcggaagtgtgaatacgcccttgcgattcggtttttggtacacgttgtacacggtgaccgccagactcgaatttgagctgtccgtaaacgccttcgccactgattttgacgataatctctttatatccgccttgttcgctttcgttagcacttagctcttcaattctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcttcaattctccagcgtttgctttccgcatagcggctgtacatacggtataaatcgcctgcgaaaatacctgcttcatcaccgcctgtgccagcacggatttcaaggaaacagttatattcatcattcggatctttcggtagtaataagatttgtaagttttgctcaagctgttcgatttcagctttgtttgcttcaatctcttcagctgctatctctttcatatcaggatcatcaagtaagatttgtgcttcttcgatgtcgctatgtaatttcttccaacgattaaaggtgctaaccacttcttccaactgagagtattctttggaataagcacagaatttttcttgatcgctgatgattgttgcgtcgcccaataaggcttgtagctcttcgtggcgttcgcttaggctgtctagtttattaataatagatgctttcattgttttgtttatctgtatttcaaatatcgctattgtaacggaaaatcacaatctgataaacgcaaaaaagcctagatattctctaggcttctagcaaaacactttgtaaaggaattattttactaagtcttttaatgctttacctgcaacgaatgctggaacgttagctgctgggatttcgattgcttcgttagtttttggattacgacctgtacgagctttacggtgatttactttgaaagtaccgaaaccgataagttgaacagaatcaccttttttaaggctttcagaaattgcgtttaaagttgcttctaatgctgctttagcatctttcttgcttaaatctgcacctgctgcgattgcatcgactaactcagttttgttcatagttttatcctctaaagatgtgtatcagttaagatggcgttaattgccaaataaaattgcaaaatgcaatgtgtagcttaattcaaacagcccgattctcaaagcaaataatgcaaaaattgttagctaaatcacattttttgactaaaatttaacccaacattgctaattccactcgttctaatctcattttttaaccctaagataagttcgatgtccctttcttcgcattcattaagcaaacgataaacctgccattgcacatctaattcgtcttgaatttctggtgcatttttcagttcttgttcatttaaactgcgatcagcttgtgtttctaaataggttgccacagtcgaaagtgaaatttggctaattttaattgcctgctctaatgtttctccggcgataatactatgtaaaacttctgctaatgcttggcaagcatcttcggcagggaatacgccgtaaaaatcaaattcattcacatcaggaataatcgcttccaatttttcgagttggttctcaaaattgattttcgcccctttgacagttaaatgttcccagactaaattgagaatattttgaaaagttttagcatcatctgaccgcttactgacctcgcaaaagagttgaaagttaggcaacatacgttcgcataaacacgccataaaggtaagatgttgccaagtttcaaaacgctcgatacgtttatgaatagggtttctcattcgttatccttatttgtgatactgctgtgaaaaggcgtgaatgctatccacaaacactttcggactttctatcggaacatcttgatggataccgtgtcccagattgaagacgtgtcctgagccttgcccaaagccagctaaaatcgctttgacttcttgttcgatacgttcagggcttgcataaagtacgcttggatccatattgccttgcaatgcaactttgtgtccgacacgacgacgagcatcagcaatatctaccgtccagtctaatcctactgcgtcacaacctgtgtcagcgatagcttccaaccatagaccaccaccttttgtaaataaggtcacaggcacttttcttccgtcgttttcacggattaagccatcgacgattttgtgcatatagcgtaaggaaaattcgttgtaatcacggtgtgccaatacgccaccccaagtgtcaaagaccattaccgactgagaaccagctttaatttgtgcattcaggtaaagaataacgctgtcagccagtttgtctaacagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgtagcaacgcaggctcggcatacatcatttttttgattttggtaaaggctttgctacttccaccttcaaccatataagtcgctaatgtccacgggctgcccgaaaaaccaatcaatggcacttcgcctttcaactcacggcgaatggtacgcaccgcattcatcacatattgcagttcttgttcaggatcaggaataggcagatgatcgacatcggctttacgctcaatcggacgagcaaatttagggccttcccctgctccaaaacttaagcctaatcccattgcatctggaatagttaaaatatcagagaataaaattgccgcatctaacgcataacgacgtaaaggctgaatagtcacttcgcacgctaaatccgcattgcgacataacgacataaaatcccctgcttctgcacgagtcgccttatattcaggcaaataacgccctgcttgacgcatcatccaaacaggtgtcatatcaacaggttcacgcaataatgcttttaaataacgatcattttttaacattgtcatactattctctcaaaataaaaatgccctatcgggcttgatagggtaaatcatatcataaattacagggatttgacgctaatcttcacgctaacttgttcacctgattgcactaattgatgaatacgagcagtttcaacgcaaaccatcgttcgatatcccgtttcactcattccgctcattgccttatgccacgggttccaaaccactacttctctggcattttgatgttcaaccataatttgacgggaatagccaagatcttggatcagcgttggttgttggttagcacgataaatctcatcaactaattccgcaattttgcgtggcgaactaaccgcttgctgttgctgaataagggaattaaaggtctgttctggtaagccaaacaattccacctgctcaatgtttttgacattaaaataactatgtaatgccacttgtgcttcgccttgagctaaatgggtaaaacgcaactgacaagttatccctaattccatctccatttttgcttctaattgctgattttcatcaaacagactaaattcaagtttgacctgatccgcttgaacttgatagtgagatagctcccacaagcgattacgagcggtaccgtgtgggggttgttttacaccaccaaaccacggataacaaatcggcacgccaccacgaatagcattgccttgctcaaacggctcaacttcactgagccaaaaaacatcttgctcagcgtgaacaggttgccagctcaataaatgcgcaccttgtaaagccaccttcgctttcactttcgggtgagtaatttcaagcactggaatttggttgtaatcgaccaatacaagctctggggtaagttgttttgtcatatttgctccttttatatagacaaaagggatgtaacgatacatccctattcttattattgatttagattttgttttgctgcggcaatcgcttcagctacacgctctaagttcacgccgcctttggcacagcgttttgtcaaacaagagtctaacgataaaatcggataaacatcatcattaatcacagaatggaattgtttaaacttatctaaatttagctcttctaatgctttcttctggctaattgcataaactactgcttcaccaacaatgtggtgtgcctcacggaacggaataccttttgcaaccaagtaatctgcaagttctgttgcatttgcgtaaccttgctgtgcagcttctttggtacgctcagtatcgactttaatatcttctaacactaatgctgaaatattgacacacgcttgccatgtttcaatcgcatcgaaaatcccttctttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttcctgcatatctttgttgtaagccaacggcaagccttttaaagttgctaataaaccgcttaacgcaccaaacacacgcccagttttaccacgcacaagctcacaggcatcagggtttttcttctgtggcattaatgatgaacctgaagtcacacgatctgagagttcgacaaagtgagattcaccactgttaaagatgatgagatcttcggcaaaacgagaaaggtgcatcatactaatagaggccgccgctaaaagttctaaaacgtgatcacggtcagatacactgtctaagctgttgcgagtagcggtttcaaatccaagatcttgtgcgagtaaatcacggtcgattgcataagccgtacccgctaacgcccctgaacctagtgggcaagtattcattcgtttataagcatcggttaaacggctgcaatctcgttctaacatctcgtaatatgccatacaccaatgggcaaaggtgatcggctgagcccgttgtaaatgggtataacctggcattacagaaagttggttagcttctgcggtttccaccaatttttcttgtaacgcacggatagactcttgtagtgaaagcacttgggctttacaccataatttcatatctacggcaacttggtcgttacggctacgtcctgtgtgcagttttttaccgagatcgccgacttttttaatcagttgtagctcaacccagctatgaatatcttccgcatcttcttgtagcacaatggctaaattaggggcaacttctgcacgcaactgctttaacgccgcaattaattcgactaattccgcttgattgatgatccctacggaatgaatggcttttgcccaaccaattgagccgtcaatatcttgtaacgccaagcggtagtcaaaacgtaatgaatcgttgaaatatttgaattgttgatctgcttgttgtgtgaaacgtccaccccaaagtgccatatccagtatcctttataaattaaattgcaaataaaaggcggtttctcaccgcttgtcttggtgattattatgcataattatgcaattcaactcaataattatttatattaagtttctatacttccatcttgtaacaatattatgcaacaatctagcgattttgtaatgcatctaagcctaatattaaacttactatggaaaactttagacaaagttggtctgaaattatgagaagatacttcaataatttccttaaaattgcaaatttttgctttcattccccccccattcgctatatcattgcaagctatttcaagaacatatttattatgttgctaggtgctgaatttttagtcagctttttttttgcattttctcaatttatgccctagggggaaaacaaaaatcaatggaaaagttagagcaaaaaccaattattgagcttcgttctataacgaaacgttatggtgaaaaaacaattattgatggcttagatcttacaattaatgacggtgagtttttaaccattcttggtccgtctggctgtggtaaaacaacggtattgcgtttaattgcaggttttgaagatttaactgatggttcaattattcttgacggacaagatgtatcgaatgttgatgcagagcaacgtccagtaaatacggttttccaaagttatgcacttttccctcatatgaccatttttgataatgtcgctttcggtttgcgtatgcaaaaagtgccagaagcggaaatcaagcctcgtgtaatggaagcgttgcgtatggtgcgtttggaagaaatggcaccgcgtaagccgtcacagctttcaggaggtcagcaacaacgtattgcgattgctcgtgcggtggttaatcagccgaaagtgttattattagatgagtcgctttctgctcttgactataaattgcgtaaagaaatgcaacacgaattaaaacagttgcaacgtcaattaggtattacctttattttcgttacccacgatcaagaagaggcattaacaatgtccgatcgtattatcgtaatgaacaaaggtaagatccaacaagatggctcgcctcgtgagatctatgaagaaccaagtaacttgttcgtagcgcgttttatcggcgaaatcaatgtgtttgatgcaacggtgattgagcgtgtgacagaaaaaacggtaaaagccaatgtggaaggtcgcatttgcgaaattcatacggaattacctgttcatccaaatcaaaaactgaaagtattgcttcgtccagaagatattgtgattgaagagcttgatgaaaacgaaagtgcaaaagcggtgattggacacgttagcgaccgtacttataaaggtatgacccttgagtctaatgtggtgttagatcacaaccaaatgaaagttttagttagtgagttctttaatgaagacgatccgcatatggatcactccgtaggacaaaaagtggcattaacgtggcacgaaggctgggaggttgtactcgacgatgaagactgctagtaagaaatttcaaaatattactgtagcggttatcttcggttggttaattttctttgtattaatcccgaacttactggtgttattcaccagttttatgaccaaagacagtagtaatctgattgaatttacgttttcccttgaaagctatggtcgtttgattgatccactttactcacaagtattgtggaactcgctctgtatggctgggattgcaaccattatttgtttggtggtgggctatccgtttgcctttatgattgcaaaattgcctgcgaaatatcgtccatttttgctctttttggtggtgttgccattctggacgaactcgcttatccgtatttacggaatgaagattttccttggcgttaaaggcgttctaaacgaaaccttgctatctttgggtattattagcgagccaatccgtatattaaataccgaaattgcggtgattatcggtttggtttacatattattgccttttatgattttgccactctattcttcgattgaaaaaattgatggacgtttattagaagcagcaaaagatttgggtgcaaatgcgttccaacgctttgttaaagtaattattccattaacaatgccgggaattgtggcgggttgcttattagttttgcttcctgcaatgggtatgttctatgtggcagacttattaggcggtgcgaaagtgttgcttgtaggtaatatcattaaaagtgagttccttgtcacgcgtaactggccatttggctctgcaatcagtattgcattaactgtcttgatggcattaatgatttatgtgtactaccgtgcaaataaactgatgaataagaaaatggagttagaataatgaatcgcgtattgaaaagcttttttatgtttgtcgtgtacgcattcttgtacattccaatcatcattttaatcatcaattcctttaatgctgaccgttatggtttaagctggaaaggttttagctggaactggtatgagcgtttatttaacaatgatacgctaattcaagcggcgacaaactcaattaccatagcctttttctcggcgacttttgcaactttaatcggtgcattaacagcgattgcactctatcgctatcgtttccgtggaaaacaatttgttggtagtatgttgtttgtggtaatgatgtcacctgatattgtaatggcagtatctttacttgccttatttatgttagttggtgtggcattgggcttctggtctttattatttgcacatattacgttctgcttaccttatgtggttgtgacggtatcctcacgtttaaacgacttcgatgcgaaaatgttagaagcggcaaaagacttaggggcgaatgaatttaccattttgcgtaaaatcttattcccattgttgctccctgcgattgtttcaggctggttattaagttttaccatctcgttagatgatgttgtggtttcttctttcgtgacaagtgcaagctatgaagtgttaccattgaagattttctcactggttaaaacaggagtaaccccagaagtcaatgcgttagcgactattatgattgtattctcacttgcgttagtggtattaagtcagttagttctgcgtaagaaagattaatactattcacaagtacactaaatcaaaagcttaattttcatacaaaagagatcctatgtaggatctctttattttttctaaatatcgtcgttttgtatcattgagtggtgctatcaaataaaggaagccaacctttggagcttacggtatgtttagggagataatgattgcgcctgaaaatatactgttctaaaatgatagtgttaaaatccacataaaattattgatgtaaaatctatttatttgagaatttaggaacaacaacgtgtcaaaaacaattcaagctttacgcggaatgaatgacctttccccaactgaaacaccattatggcagtgggtcgaaagcaatatccgtgatactttcgcaagttatggctacacagaaatgcgtagtccgattatggaatccaccgacttatttaaacgtggcgtcggtgaagcgacagatattgtcgagaaagagatgtttacctttagccgtagcgaagaagcaggcgaaagttttactcttcgccctgaaggtacggcaggttgcgtgcgtgcggcgattgaacacggttggatttacaaccaagaacaacgtctatggtatattggtccgatgttccgctatgagcgtccgcaaaaaggtcgttatcgtcaattccaccaagctggcgttgaaattttcgggatcccaaatgctgaagcagatgcggaattaattgtgttaaccgctcgcttatgggaaaaattaggtatccgtgaacacgtgactttacagcttaactcaatcggcggattggaagtgcgtactcgataccgtgaagctctagttgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctctagttgctttcttgcaaaatcatttagacgtattaaagcaagatcctgacagcgaacgccgtttaacaaccaacccattacgcattttggataccaaaaatcaagcgttacaagcagtattaaacgatgcaccaaaacttcacgatttcttagatgatgaatcgaaagcacattttgctaaactttgtgcaatccttgatgaaatgggtattgcctacgaagtcaatcaaaaattagtgcgtggtttggattactacaataaaaccgtatttgagtgggtcaccacagcattaggtgcgcaaggtacagtttgtggcggtggtcgctatgatggcttagttgcacaactcggcggacacgcaacggaaggtgttggctttgctatgggcttagagcgtttagtcttgttagtgcaagaagtgaacccgaatgtgcaattaccaagagctgttgatatttatgtagttcattcaggtgaaggcacaacggcagttgcattccgtttgactgaaaccttgcgtaatgcgttcccacaacttcgcacaatgctacatacaagcggtgggaatttcaaaaaacaattcaaacgtgccgataaatcaggggcgaaaattgctttggtgttaggtgaaagtgaagtcgccgagcagaaagtggtagtaaaagacctatttggtgaagcggagcaaatgaccattgcccaagctgatttaatcaacgaattaacaacgcgttttgcatagggagcagaaatgagcgattatcttaataaaaccgaagaacagcagtttgaagaagcaaaaagctggtttaaagaaaatggcacaccgattgttgtggcaatttttctagttgcagcagcaacatttggctggaactactggcaaaaacatcaaattgaagtagctcaaaccacatcagccagctaccaacaagtgatggaaagctatttgcaaaatcctgaaaaaaacgcaccgcttgtacaaaaatttattgcggagaataaagactcaagttacgcggtatttgctcaactcgaagaagcaaaacaagcggcagataaaggcgattttgcgacaacaaaaacgttattaacacagtctttaggttcgacaaccgatgcaacattacaaaacgtgatccgttttcgtcttgctacagtggattatcagctaaaagagtttgatgcagcattagcaacactttctcaaatcaaagacaccgcttgggatttccgtaagcagttattaacaggtgatctgttagccgcaaaaggcgacaaggcggctgcgaaaagtgcttatgagcaagccaaagaaaaagcgggtgatgcaaatcaaatgctaattgatgtgcgtttaaataatctgtaaaaaggtaatagtagagaaatccttaatgaatgttaaggttatctgcttcttggtaattaaagaaaatagctcctagaggcagatatttcacggaattaaagttaaggtgttactgaatgctatttgtatcttctggtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggtagtcaatgccatgtgatttttaaatgataataaccttttatagttgaattaagttctaacatactctctctttcttctctattaataaattatatttttatatataaattaaacaagtaatgcttgattttcttcgcaaaaaattaccttctatgaacagagtatggaaaatgttataaagcaataatattgctatctatttatatggtatgtggatatttcacgtcaataaatctggaagattttgatgattggaggaacaaatgcaacacaaaaaaatcgcctttatcggtgctggtaatatggcatttgcgatcatttcaggattaatcaaaagcggttatcctgccgagcaaattatcgctcgtaataaaagcaatgaaactcgccgctcgcagttaagagcaatgggcgttcaggtggatttgtctaacctcgatgctgtgacccaagctgacgtggtgattttagcggttaaaccgcagatgatggcggaagtatgcagtgagttttctcaagtggattttagtgcaaaatgggtgatttccgttgcggctggaatttctgttgcccgtcttgagcaactgttaccaacagcaagcaacattgttcggacaatgccgaatacgccatcgctcattggtgaaggcattgcaggattatttgcaaaaaaatcggtagatccgaccgcttgtcaatttgcagaacagctactgtctgcggtaggcaaatgttattgggtggatacggaagcggagatcaaccaaattattgctatcacaggttctagccctgcttacttctttaagtttatggaagcaatgcaagaagcggcaattaaaatgggctttagcgaacaaaatgctcgttatttagtgcaatcggcagcattaggggcagcaaaaatggtggtagaaaatccagaagttgccttagcaaccttacgcgaaaatgtcacttcaaaaggcggcacaacggctcaagcattggcggtatttgaacaacgtgagctaaatgtaaccgttgaacaagcgatgaatgcggcaattaagcgtgcagaagagatggaaaaatccctatgataaaatttaccccttttcaatggtcgtcgtttaacttcttcggcttttattgtgcctatggcgtgctgttgccgtttctacctgtttggttgaaccatcatggctacgattcgggaatgattggcttgttaatcgcttcaggttatctattccgctttttaggggcaatgaccttttctaaacgcattacccaccccaaccagctactttcttttgctcgttggctaacgtggctcgccattgccactctgtttttagttgcctttggggtacaaacaatttggattttattccctgcaatcgcactgttccatatcttcaacggcggagcaatgccgatagctgataccatagcttccacttggcaacagcaagtcgggattgattatggcagaacacgtttatttggctcgattgcctttgttgtaggctcagttagcacaggctatttagtcggctggctaggggaaagtgcaattatcggcattttgatcggctggctagtctttttaggcactggcttaacggtcaatccgacccaaacctttgtacaaacggaagaaaaagcccaatcagatttaagctatctgcaattaatgaaagtgccaaccacattcaaaatgttgattgccgtttccttaattcaatcttctcacgccgcttattatgcttatagtacgatttattgggcatcggcaggcatttcgacccaaagtgcgagtttgttatggggattggcagctgtttctgaaattctgtttttcttctttgccaaccgtgtatttaaaacgtggaaaatcagccatttaatgatcttatctgccattagctcaatggtgcgttggattttactggcttccaccaccaatatggcgatcttaatggcaatgcagatgttccattctatctcttatggagcagggcattatgcaatgatccgctacctttcaacccaacccacggaacaaatggcaaaactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagcactctattttagctttgcaagctgtatttttatggcgttgttcacctttannnnggttaatggtgttgtttgcactgcctgcgatttttatcgtgccgaagcggtttggggtgagggtttagatgaatgaatacctaacatatcaattcaataataatttaaggggctgtattagattagccacaccattttctcaacattttaagtcactcttttggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaagcctttttctttctgttttaaggcgtgcaaaatgagggttaaaacgatatgtttaaggacatcggcgtggttgcctgcgtgaaaactgtgatgataactcagcatttttattctctttcttgtaaaatggctctattttagcttatttagtcgttttaaactatgcagaaaacgttaaagattgaaaatggttggctgttaaataccaaacaagtaccttcaccgcactttaatccaagaccctatcaagacgatatttctcttttggtcattcattatattagcttgccccctgatgaatttggcggtgattttattgaccgtttttttgaaggcaagttagacccaacccttcacccctattttgaagagattaaagatttacgggtttccgctcactgtttaattaatcgagaagggcaaattactcaatatgtcaattttaacgatatggcttggcacgctggcgtttcttgctttgaagggcgtgaaaaatgcaatgagttttctatcggaattgagctagaaggcagtaataaccagccttttaccgaagcgcaatatcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagcgcaatatcaaaccttagctagccttacgcgagtgattatgcaagcctatccgcaaattacgcctgagcgtatcgcaggtcacaatcaaattgccccagaacgaaaaatcgaccctgggcagtattttgagtggggatattacgacttactacttaggtatattcttaagtaaacccaataaaaaacgccaataaaatcggcacaaccaaattgataataaagccgaaactgattgcaagaggcacaatctgaatacctcctgatttttgaataatcggcaatgtggcatcaagtgcggtagctccgccaagtcctacggctgttgagggaaagtgacgcataaaaaacggtatcgcaaataagcagaagatttctcttgagagatcgttgaaaaaggcaatgctaccgtccattgccccccaagcatcattgactaatacgcttgaaagggaataccaaccaaaaccagaagcaaagacaagggctttaatcatcggcaaatcaagcagataagcacaaagaataccgccaatcagaccgcttgcgataaagacgacggaagtcaaaatgccacgagtatttaaaaatacatcacgcagtggaatgccgctgtttctaagttgaaccccgacacagaaaatcattaccactaggacataggtgcttgaatgtaaagggaaatcaaccacatttttagttgaaaagcctaaaattaccccgacaaaaaccgttgcacagagttgtgtcgactcaagcaaaaccttccaacgagatggcaattcttcaaggctatgagcctcacgtttgatcgggtaacacttatcaaaaatgagtaaacagacaatgttgcaaaggtgtagaattgcacttaaaccaaatgccgttgctccaatttgtggtagtttggtcgttaattcatctaattgcccaagcgaaatccccataatcaataaaatcaggtataagcagtaaagcgtaatgcgattgacccaattgagtatctgttgatttgtcgtttggaaaagataccctaagaacagtgggacaaaggcgatcattagtccgtatagcataatttctccttttgccaataaagcaaggaatgtaatagataatttaacgaagataaactgtttttatttacagtgttttattgtatcattaagaatacataagcggtcagatttctctcacggtttacaaatataggcgagcaatgaattacaacaaaaaaattattcatattgatatggattgcttttatgcttctattgaaattcgcaataatccaagtttaaaaggaaagcctgttgcagtagggggaaaagctaatcaacgtggggtgctgacaacctgtaattatgaagcgcgtaaattcggcttgcatagtgcgatgtccacttctcaagcgttaaaacgttgcccgaatttaattttattgcctgtcaatatgtcgctttataaggcggtatcagagcaaattcattgcatttttcgccgttataccgacatcattgagccgatctctttagatgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccgatctctttagatgaagcctacctcgatgtgaccgcttgtaagcaacattcaggctctgcaacttggatagcccaagccattcgtcaggatatttggcaagagctacaacttacttcatcagcaggtattgcaccgctgaaatttctagcaaaaatcgcttccgatcaaaataagcccaacggacaatttgttatttgccccgaagaggttgcggattttgtgaaaaccttgccgttaaagaaaatttcaggggtgggcaaagtggcccaagaaaagctggcacaacttggatttatcacctgtggcgatattcaacaagcagatcaggctttgatttatcaacagtttggtaagtttgggcaacgcttatgggatttctgtcacggcatcgatccaagagaagtcgagcctcaccgccctcgaaaatcgcttgcagtggaaaataccttactttctgatcttgatacactcactgaggcggaagatgtggtgaaatcgcactatcaaaccttactctttcggcttcaacgcaactggggcgataagccactgagcgatttaaaaaagatcggaattaaactgaaatttgatgatttcacccaaactacactagagcgaaccacagacggtatcgcagaacaccattttttacagctattacaacagatttggcaacgacgaaaggggcgaaaaattcgtttgatcggattgaatgtgcattttcctgaagaaaaaattacgaagcaattaaatttatgggaataatttttgtctaatccttgatttttgttaaataatcattatgttaagcattcggtaatcgcttattaccgaataacaacaatttattaactttggagaattatctatatgatgcgtatcgcacttttccttgcgacaaactttgcagtaatgattgtgctagggattattttaagtgttactggcattgctggaaacagtacgggtggaattttaattatgtctgtgctttttggttttgctggttctttaatctcattatttatgtcaaaaacaatggcattaaaatcagtgggagcagaaattatcactgaaccacgcaacaatgcagagcgttggttggttgaaacagtgaaacgccaatcgcaacaagcgggtattccaatgccagatgttgcaatttaccactcagctgatgtaaacgcatttgcaacaggggcaaccaaaagtaactcgctagttgcagtgagtacaggtttgttaaacacaatgacagaagacgaagcagaagcagttgtggcacacgaagtagcacatattgctaatggcgatatggtcacaatgactttattgcaaggggtattaaatacctttgttatcttcctctctcgtatgattgcaacggcagtatccagtagccgtaatgatgatggcgaagaaacccaaagtagtggcacttacttcttagtatcaatggttctggaaatacttttcggcgtattagcaaccatcattgcaatgtggttctctcgttaccgtgagttccgtgcagatgcaggctcggctcaattagtgggtaaagagaaaatgattgcggcgttgcaacgtttacaacgtgttcacgatccagaagaattacctggttcattaaatgcgatgatgattaacggtaaagcaaaagagttctttatgagccacccaccgttagaaaaacgtattgaagcgttgagaaatttatagtgagataatattattcactataatttagggtatcgaaaataatctcagccaaagatactgaaattccaggaaccgatttaatttcatcaagtgttgctgatttgacgccttgcataccaccgagatattttagcaacaaatggcggcgtttagccccaacgccggcgattgcctctaaaccgctttcggtaaaggctttttgccgttttttacggtgtccgctaatggcgtggttatgggattcatcacggatatgctgaattaaatgtaacgcagggctgtcgggtggtaagtggatttccttgtcccatttgctgatcagcaaggtttctagcccagcttttcgttctacgccttttgccacgccgatgagtaatggtttggatttatcccattccactttgagattggcaaaggtgtctaaggctcgatttaactgcccttttccgccgtcaataaaaataatatcagggattttttcaggcggtagcggtttatcataacgtttgagcagggcttgttccattgcggcataatcatcgccccctgtaataccttcaatgttgaaacggcgatagtcggattttaacggtccattttcatcaaacaccacacaagaagcgaccgtttgttcgcccatcgtatgactgatgtcgaaacattccattcttgcaatttttggcaaagaaagcaccgcttgtaaagcttcataacgggtttggattcgagcatcttgcttgagctgtaaggtcaatgctgccattgcgttcgttttggcaagcgcaagataacggcttttttcaccacgcactttatcggtaatgctcactttatgccctgcttgttccgataataccttttctaaggcgtccacttcgctcacggagtgatcgataataatttgatgcggaatggtgcgatgttggttcatctgcaaatagaattgcccgataaaagtgtcactcaattcggcaaattcggtatggttcggcacctttgggaaataacttcggctacccaacattttcccttgtcgtacaaacagaatatgtacgcaagcgataccgtgttggtaggcaatcgaaataatatcgagatcgtctagacgttcattcgatacaaattgcttttcagtgaccactcgcatctgctgaatttgatctcgaaaacgggcagcagcttcaaaatccagatcttccgcagctttttccattttaccgatcaaatgttcgatcacttgctgatctttaccttgtaagaataagcgaacatactccacctgttgatcgtattctcgttgggaataaacgccttcaacgcaaggggcaaggcaacgcccgatttgatactgcaaacaaggacgagaacggtttttgtagtagctgtcttcacactggcggatcggaaacagtttttggagcagatttaaggtttctcgcaccgcccctgcatttgggtaaggtccaaaatattccccagcaatttttttgctcccccgaaagctggctaaacgagggtgctggtgtttggtgagcaaaatataagggtaagatttatcgtcacggagcaacacattgtatttcggttgattttccttaatgtaattgtgttccaacagtaaggcttcggtttccgaatgggtaatggtggtatcaatatgagcaatttgcgagaccaaggcttcagtttttcggctggcaagattgctacgaaaatagctcgatagacgcttttttaaatcttttgccttaccgacatagatgatcgtgcctttatcatcatacatacgataaacaccagggttatgtggcgtatcgacaagaaattgtttggaattgaattttgacatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttaagattttaataaactgcctttagatgctttcaagtattgcaacatcgaccaaatggttaaaatcgcagcgatatagagcaaagcaaaggcggcatattccatccacgctgtttgtcgccataataaaccacccaatgccaacatttgtgcagtcgttttcactttaccccaaatcgacaccgctacactcgcacgttcgcctaattccgccatccactcacgcaacgccgaaataataatctcacgggcaatcataatgccagctggaatagtgatccaccaagtatggtagtattcgaccacagacaccaatgcaatcgcgattaaaactttgtctgccacaggatctaaaaatgcccctaagcgagtagtttggttccacttgcgagccaaatagccgtcaaaccagtcagtaattgaagcaataaaaaaaatcaacgtggtaatttcagcagaatattgaataggcaagtaaaacgaaacaataaacagcggaattaacgccacacgaaataaagtcagataggtcggaatgttgagtttcatacgttacaggtcgaataaaggtattctctatattctattataaagtagatgaaagaagaaagcgataatgccataactcttattatttttctaaatagatagataaaaagaataaatattgtagaatacggactatggtagtgaatgaaatgttaatattttctttttcccaacaagaacttaatgccatttatttaagcctaaaaattgccagtatagcggtcttatttgcgctgccttttgccattggggctgcgtggttgttggctcgaaaagagttttggggtaagcatttatttaatggcattatccatttgccgttagtcttgccccctgtggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcggttatcttttgctgattttaatggcaaagaaaggggcgattgggcaatatttgtggcagtggtttgagttttcgttaagtttttcttggaaaggggcggtgcttgcttcaatggtaatggctttcccattgatggttcgctctattcggttagcttttgacgctatcgatcccaaattggaacaggcggctagaactttaggggcaagtccattaagagtgttttttacacttcatcttccgctctctttttcggggattattgcaggggcggtgttaggttttgctcgttcgttaggggaatttggggcgaccattacttttgtgtccaatatccctaatcaaacccaaactattcctgcggcactttatacgtttattgaaacccctgacggtgaaatggcggcggctcgtctgtgtgtgattgcgattgtgatttcgttagttgcgttatttttttctgagttattggcacaacgtcagcaacgtttccaacaaattaagggacagtaatggcacaatctttgcaacttaaagttaaacatcgtttaggaaacttggatttagctgttgatgtggcgttaaatgctaaaggggtgacggcaatttttggtcgctctggggcagggaagtcgagtttaattaatcttatcgcagggctagttacaccaacggaaggacgaattgtgttaaatgggcgagtgttgtttgatgctagccagaagatcaatttaccccctgaaaaacgtaaggtgggctatgttttccaagaacatcgcttatttccgcattatcgagttgaggcgaatttaaaatatggctgtaagaggtttgatgaggcgaatttttcagaattagttaaattgttggggattgaacatctgttagatcgtttcccgatcagcttgtctggtggtgaaaaacaacgtgtggcgattgggcgtgcgttgttgagcgagccagatattttgttgatggatgagcctctttcagctttagatttaccgcgtaagaatgagttgatggactatttggggcggttggcaaaaacggtggatattccgattttgtatgtaagccatagccttgatgaggttattcgtttggcggataatttgttgttgttggaagaggggaaggtggttgcttttgataaaacgttgaatgtttggcatagcccagccttttctgcgtggcagcctgaagctcaacggttgagtttacttgagctgcctgttgtcgctcaaaatccttaccgtatgcaagggctggcattgggacaacagttaatttgggttacggaacagcctcgctatcaattaggggatttaatgcgaattagcattggtagccaaaatgtttctattaccctgtctaaacctgagcaaagttctattcggaatattctgcaagggcgaatttgtaaaatcgagcctcaatctgaccgctatgatattgccgttgaggtggaagctcaagaaatttgggcgagtatcagtttgtgggcgtttgatgatctgtgcttgcaaatagggcagatggcgtatttgcaggttaagagtgtggtgatttagattagattcttaatttttctatatatttgaatggtattttttatttaccaagctataaaggagtttgataagcaacaaggctacatttaaaaatagctattacgaggtcgctgtaatttgcgatagatcaaaaaaatatatattatcttcttattatttgttactatagttgagagtttacactcaattgttactgattatttttgaggaacataatatggcatacacattacctgagttagattatacctatgatgcattagatccgtattttgatgcaagaacaatggagattcatcactccaaacaccatcaaacctatattaataatgcaaatatcgcattagaggcatatcctgatttactaggacaatgtccaggaaagctgatctcaaatcttgagcaagttcctgtagaaaaacgagtagctgtgcgtaacaatgtaggaggacatgttaatcacacgttgttttggaaagggttaaaaactggtacgaccttacaaggaaaactcaaagagaccataatacgggattttggttctgttgaaacattccaagaacaatttgagctggctgctaccactcgttttggttctggatgggcgtggctagtactagaagatggaaagttatctgtagtatcgacagctaaccaagattctccgttaatgggtaaagatgtagctggtgtgtctggttatccaattttaggtttagatgtatgggaacatgcatattacttaagttaccagaaccgtcgtcctgattatattaaagcattttggaatgtggtgaattgggacgaagcagccagacgttttgaatcccaagcataacgcaactgtgagtagtgtatggttgctaatgaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctttttctaccttgatacccattcgggtgtggggcgttatagcttgcaaagtagcgaagcggaaaaaacaggggaatatattgaaggtatagctcgcctttgggagagaaccgatctccccgaagaagttgtcttgtacctaaatgaaatcaaaaaaattaacaaagataagctacgtttttacgcaggctcgccgttacttgccgtgcaacaattacgtccacaggacagagcgttactcacagagttacaccctaacgacttcccactacttcgcaatgaatttgccaaaacacctaatgtggtgacaaaacgtgaaaacggttttcagcagttaaaatctgccttaccgccaaaagaaaagcgtggtttggtgctgatcgatccgccttatgaattaaaagaagattatgaactggtggtaaaagccattgaagaaggctacaaacgctttgccacaggcgtttatgcgatttggtatcctgtggtgcttcgccaacataccaaacgtatcgtaagaggcctagttgaaacggggatccgcaaaattttacagattgaattagccgttcgccctgactcagaccaacgaggtatgactgcaagcggtatgattgtaattaatccaccgtggcagttagaaagtcaaatgaaaaagattttaccctatttaactgatgtgcttgtgccagaaggaacaggcagttggacggtagagtggattacgcctgagtagatatatcaaataagtataaggaaactaacaatgcaacaatacaaacacgactttatcgaatttgccttaagccgaaatgtactgaaattcggcgaatttaccctaaaatcaggcagacaaagcccttatttctttaacgcaggattgtttaatacaggcagagatctcgccaaattaggcgaatattacgctaaagcaatccaagccagccaaattgactatgatgtgctattcggacctgcttacaagggtattccgattgcgactactgtggcagtggcgttagcaaatcaatttgatgtagataagccttgttgctttaaccgtaaagaagttaaagatcacggcgaaggcggaaatcttattggtagtccattaaaaggcaaaattttattggtggacgatgtaattactgcaggcacagcaattcgtgaatcaatggaaatcattcaagccaataatgcaaccttagcgggcgtgatgatcgcgttaaaccgtaaagaaaaaggcaaaggcgaactttcggcgatccaagaagtagaacgtgattacgattgtcaggttttctctattattgattttgatgatcttgttagcttcttagaaagatcagagcaatatactgaatatttgccaaaaatgagagaatatcgcgagaagtatggtattaaataatcggtttaaaatttaacaatatactgaaagattgttgttttgtgtctatttttgtaaatattagtgactattttatgtaagcaactttttaaggcatattagacaaaatggtcactatgcctattgcaggcgtaatagacaaatttgttgctaaaaagtggcttaaagccttatagtacaaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagaaaaagttttatgacattcattacaaaaataacgttgaatattatttcttataccatgtttgcggatatcgctactgtggcaaactagctataataaaaacggcactttaagtgccgtttctatttctatggttaagatcttttcataatctcaaaaaactcatcgttggtttttgcgaccatcaatttatcaataaggaactccattgcttccacttcacccattgggttaaggattttgcgtaaaatccacattttttgtaattcatctgggcttgtgagtagatcttctttacgcgtgcctgaacggttaaagtcaatcgctgggaatacacggcgttctgcaattttgcgagaaaggtgtaattccatattacctgttcctttgaactcttcaaagataacttcgtccatttttgaacctgtatccacaagtgccgttgcaataatggttaagctaccgccttcttctacgttacgagcagcaccaaagaaacgttttgggcggtgtaaagcgttagcgtccacaccaccagaaagaattttaccagacgcaggggttactgtgttgtaagctcgtgctaaacgtgtgatagagtctaataaaataaccacatcttttttatgttcgactaaacgtttcgctttttcaattaccatttcggcaacttgaacgtggcgagttgcaggttcatcaaaggttgaagcaattacttcgcctttcacagaacgttgcatttcagttacttcttccgggcgttcatcaattaataaaacaattaattcgcactcaggatagttatgggtaatgctttgagcaatgttttgaagtaaaacggttttaccggcttttggcggtgctacgatcaaaccacgctgacctttaccgattggtgaagctaaatctaagatacgtgcagttaaatcttcttttgaaccattaccacgctccatacgcaaacgtgagttagcgtgaagtggcgttaagttttcaaagagaattttgctacgagaaacttcaggtttgtcatcattaactaaatctacttttagcaatgcaaagtaacgttcgccttcttttggtgggcggattttaccttcgattttgtcaccagtttgaagattgaaacggcggatttgacttggggaaacgtagatatcatcagggcctgcaaggtaagaactatcggcagaacggaggaaaccaaaaccatcaggtaagatttctaacacgccttgaccgaaaatgtcttcaccactttttgcgtgttgtttcaaaatggcaaagataatatcttgtttgcgtaagcgagctaagttttctagccccatttgttcttcaccgatacggacaagttccgatacgggtgtattttttaactctgtaagatgcatagaaataataattgtgttatttaaagattggattaaaacaggttaattcagatttgtttgtatgaattgtggtggcgaagaatacagcgaaaaggaaaattttgcaaattttttctgtcttattaccgcttgtttgtgtgaaaaagggtaaaatagttgaaaaaaaggggaaaaatggctgataatatcaatgaagttcgcttggataagtggctatgggcggcacgcttttacaaaactcgttcaattgcaaaggcgatgattgaaggtggtaaagtccattacaatgggcaacgagctaaaaccagtaaaatagtcgaagtcggggcaataattaaattacgccaaggcaacgatgaaaaagaagttgttgtcactacgttgagcgatcaacgacgtggtgcgcctgaagcacaactgctttatcaagaaacggaaaaaagtattcaagaacgagaaaaaatcgcctttgcccgtaaagcaaatgcgttatcaatgccacacccagatcgtcgtccaaataaaaaagagcggcgggatttgattaaatttaaatatcaagagaacgatttgtaattacttaaatcgtccccatatatgttttgtaatggcggtgatttttctcaccgcttgtattttatgaaggattgttaatgacaacttacacacaagataacgataaactttatcgttttttatttcaaaaccgtgcggtgcgtggagaatgggttcgcttaaatgacacctttacggaaaccttaaatacccaccactatccaacagcagtgcaaaatctactaggtgaaatgttggtagcaaccagtttattaacggcaacactcaaatttgaagggacaattgccgttcaaattcaaggtgacggagcgttaaaattagcggtggtaaacggcaatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaacaacaatttcgtgctttagctcgtgttgaaggtgatattgcggataacgcaacacttgctgaaatggttggaaatggtgttctcgttatttcgattattccagaaaaaggtgaacgttatcaaggggttatagtcttagataaacctactgttagtgagtgtttagaagactattttgctcgttcagaacagctcgccacacagcttgtgatccgtgttggtgaatatcaaggcaaagccgttgctggtggaacattactacagatcgtgccagatggcactggttcaccagacgactttgagcatttggcgacattaacttcgacgatcaaagatgaagagctatttggtttaacggcagaagaactactctatcgtttgttccacgaagaaacagtagaagtttatcaaccacagtccacagagtttaagtgtggttgctcaagagagcgttcaggggcggcgattttgttactgcctgaagaagaaattgcagagatgttagccgaaaaacaaggggtaattgatatgcagtgcgagtgttgcggtacgcaatatttcttcgaccaaaaagcgattgatgaattaaaagcggatagttaatttgaacgacaagcggtaagattagtaaaacattttgcaaatcctaccgcttgtaacttaggaaaatacaatgagcgaacagcaaatattacgccaagttgtactcgatactgaaactacgggaatgaatttcaatggtgctccacacattgggcataacatcattgaaattggtgctgtcgaagtaattaaccgccgtttaactgggcggacttttcacgtttatatcaaaccgccaagagaagtcgaggcagaggcaatgcaagttcacggtattaccaacgaaatgttggcggataagcctgcatttgctgaaattgccgatgagtttattgaatttatcaaaggggcagagctgattatccataatgcccccttcgacgtaggatttattgaccacgagttttccttcttgccaaatccccctgaaaaagtggcacagatgtgtaccgtcacggacagcttgcaacttgctcgtaagatgtatccagggaaacgtaacaatttagatgcgttatgtgaccgcttggggattgataacagtaaacgtgtcctgcacggtgcattactggatgcggagatcttggctgatgtgttcctgataatgacaggcggtcaaattgcccttattggtgaagatgaacacgagcaagcaaaaacatcttcagtagagcaagtttaccagccgttaaatatcgatacctctaacttgattgtattagcccctgacgaagaagaattagcagaacatcttaaatatcttgagttgataaataaaaaatcaaaaggaaattgcctttggacgagagaactggcgacagaaaacacgactgtgaattaaaaagagagcgttttgtatagtaaaaagacaatcaataaattttttcaaaaaagtgtttgacggtagagagcgaaatcattaatatacgcctcgttcactgcggagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattccgccaactaatttaagaagcatataaaaagccaaccatatatctatggttggctttttatttagactatctatacgtagtaacagatataggtgtaatagacaaattttatttatacatcataagtcgtcgatgccgtatttccaccacgtcccgtccagttggtgtggaagaactccccgcgtggtttgtcggtacgctcataagtgtgtgcaccgaagtagtcacgttgtgcttgaagtaagtttgcaggcactcgctcagaagtatacccgtctaaaaargtaatcgcgcttgccatacaaggcatcgggatacccacttcgatagacttcgctaccactttacgccagtcgcttaaggcgttttctaaaatgcctttgaagtacgcatctgagcctaagaatactaagtctgggtttgcctcatacgcatcacgaatgttgcctaagaaacggctgcgaatgatacaaccttcacgccataataacgctgttgcaccgtagttgatgtcccaaccgaagttttcagaggcttcacgaataagtataaagccttgtgcgtaagagatgatttttgatgccaataacgctttacgcaccgcttcgatccaaacttgtttgtcgccttcaactttgccgatggttttgttgaacaatttagatgaggcaacacgttgatctttgaatgaagagacgcaacgagcaaatactgactcggtgattaaagttaatggaataccgaaatctaatgcgttgatccctgtccatttacctgtacctttttgacctgcggtatcaagaattttttccacaagtggcgtgccgtctgtgtctttgtagcctaaaatatcggtcgtgatgtcgattaaatagctatcaagttccgtttttttccattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaatcaaatcgctggcttgtaatggcacggatttttccagcatctccgctttgacgatactctggtcttggcttgccaacaagcggtcgtaataaagcgtagaaatgttacgatcaagagttcttaccgaccaattattttcagcggcctcttttagataataaagacgagctttgtcgtttgatacctttaatgaacgctgaaaatgagaccacgataattgtgcgaacaccgttcgcacttttggaaaatcaggaaataaaacatagaattgtcgcatttcccacaggctacgtttactaaaacctttgccaaactcattcgttaattcaacagaaagattttttataatctctttcccataagccgcccgatcagctccattttgttcttccaacacaatacgttcgccaattttccaataggcttcaaccattgctgaattgacagcggtataagccttttggcgtgcattggcgagaatttgtttaatttctaaaagataactgctgttgattaaatccatatttagctccggtaatcgcttaaaaattaagatatatttttacaacaacttcgccacatcgctatccaaataccactccgttacgccatttttggctttaatttttgctgctgggtaaggcaggttttccgctggtgttgtttggatttctttgagaatttctgctttacttgcccctgtgaccaaataagtcactcgttttgcctgttcaatcaatttggcagttttggaaatacgaatttgccctgtttcagggtgtttggcaataaccgctaaatttggatcattgaaatttgtttgatgtgggaatagggaggcggtatgtccgtctgctcccatacctaaaataatccaatcaaactcgccattaggtacacaagcggtcagttcttgtgaaaatcttaccagttcttgctccacaggctcttcaccacgaatacggtggatattttccgttgggatttgaatatgatcgaacagtaatttttgcacttcaccataattgctttcaggatcttgaggcggaaccatacggtcatcgccccaccaaaaatggagattttgccattgaatttggcttttatacggctcttgggcaagggttttaaacagcagttttggcgtgcttccgcctgatagggaaatatgtacggggcggttttgttcactataagccttaaattcttcggcgattttctcaacagcattttgagcggtgttaaaaataattgtgttcatttcactttccttaaaatcccccttaatccccctttttcaaagggggaaatttatgaggaatagatgatcttgtatttatttccccctctttgaaaaagagggggcagggggagatttaaacttttttcttcatcaaaccgcttggtttacgccacacttcgccgtgtttggcgatcaatttatcggcttcagaaggcccccaagtacctgcttcgtattcataaatacgcccacgttccgctttatagtccaaaatcggttgaacaaatttccagcaggcgtgtactgcatcggtacgagcgaatagggttgcatcgcctttcattgcatctaataatagacgttcataagccgttaataggcttggtgaagcaagatcggcatagcggaaatccattgatacttctttcgcttcaaagccagcaccaggttttttcaagccgaaacgcattgaaatgccttcgtcgggttggatacgaataatcaatttattatcaggggcattttgactaaagactgggtgtggggtggttttaaagtgaataaccacttctgtaacacgagctggtagacgttttcctgttcgtacatagaatggcacaccagcccaacgccagttgtcaatttggcaacgtactgccatataggtttcagtgttagagtcttcaggcacacctttttcttgtagatagcctttaacttcttcgccgttaatggtgcttgcggtatattgtcctaaaacaaggttatttttaatatcatcatttgaaagtggatgcagacaatgtagtactttcgctacttcatcacgcattgaatcggcattaataatcgcaggtggctccattgcgaccattgctaacacttgcaataaatggttttggaacatatcacgcattgcacctgagccatcataataaccgccacgatcttctacaccaatagattctgcccctgtgatttcaacataatcgataaaattacggttccagagcggttcaaatagaccattagaaaaacgcaaaacgagcaaattttgaacggtttctttgcctaaataatggtcgatacggtagatctgatgctcttcaaaatacttgtgaatttgaatatcaagggcttttgccgtttcaatatcgtagccgaaaggcttctcaacaatgatccgtttccagccaaattcttctgttgttaaaccgtgtgctgaaaggcattcagggataacgccgtataaactgggtggcgtagaaagataatatagcgtattaccgcctgtgccatatttgtcgtgcagttcatctaaacgtggcaataattttgcataatccactgcatcagacgtatttaccgattgataataaaggtgttcgcaaaatttttctaacacatcaccgcttgcattttcaagtttgactaaggtgtcgtgcattttttgacgaaaagtttcatcggtcaaaggggaacgagcgacccctaatacagaaaaatgttcagaaagtctgccgattttataaagattataaagggctggaattaacttgcggtaggtgagatccccagacgcaccaaaaatcacaatacaattattgtctgctttcatttgcaatcctagaaaatgtaaaaaaattgttagatttcataacaaaatataacaataaataaaatcaattaaaagaaaaaatctgttgccaatcacgttgtttatttgccaccattataaaataagggtttacaaaggtttcacgttgattatagcttaacggttggaagtgaagatcgaagacctgaccgcctgtttctgcgagtaacacttcagcaacagccgtatcccattctccagtatcccctaaacgcacatagcaatccgccttaccttcagcaaccaacccagcttttaagctacttgaaccgaattgaagaaaatctacttgataagggggaagcacagcttggcgaattttgtcgctacttgacgtaccaatagtcacttgcaagcggtgtgatttatcgtcattttggctattcgaattaagacgatggatctcgccattttctctaacaaaagcaccgcttgcacgcattgcatagtaggttttgtctaagatcggcgaatgaatgacacccagaacagggcgattttgctgaaccaacccaatcacaactgaaaattgatctgttctatcaataaattgctgtgttccatcaagtggatcgacgatccaatattcttgccattgcgaacgctccgaaagtggaattttacagttctcttctgacaagatcggcacatttggggtcaatttctgtaattgttcaatcacaaactggctaataaaaagatcagcttcagtcacaggggttttatctgctttaatctgaatttccacagaacgctgataaaagcgtttgagatgttctcctgcttgaacggcaatattaaggacatcatttaatagttgttgagtaagtgtttgcatataaaactccttaatttatctctcaataataccgcacaatgtgttgaaagccaaaggttattgatcggctaatagacattggccgctagcttacaacatttgtgttttatatctagggtttaaagggtaaaggtaaatacatgattcttatacaaggataaatcccctagtttgtcatcctcctagatttcgctataatgctccgcttttaaaactacaaggaataactatgtttgaactcaatccgattagaacccaattagatgatttagccgaacgaacccgtacacttcgggggtatctttgacttcaatctgaaagtcgaacgcttagaagaagtcaatgccgaattagagcagcctgatgtctggaataatgctgaaaaagctcaggcgttaggcaaagaacgtgttgctcttgaaactattgtgaatacgattaaaacacttgagcaaggcattgaagatgtcgaaggcttgattgagcttgccgttgaagcggaagatgaagaaacttttaacgaagctcaacaagaagctaaccagttagaagaaaaattagccttgttagagttccgccgtatgtttagcggtcagcacgatgtggcagattgctatgtggatttacaagctggttcaggcggcacggaagcgcaagactggacggaaatgttactgcgtatgtatttacgttgggcagaaagcaaaggctttaaaaccgagttgatcgaagtatccgatggcgatgtggcaggattaaaatcggcgacaattcgtgtgtcaggcgaatatgctttcggttggcttcgtacggaaacagggatccaccgtttagtgcgtaaaagtccgtttgactccaataaccgccgtcacacctcttttgcagcagcctttgtctatcctgaagttgatgatgattttgacattgaaatcaaccctgccgatctacgtattgacgtgtatcgtgcttctggtgcaggcggtcagcacgttaataaaacggagtctgcagtgcgtattacccatatgccatcaggtattgtggtgcagtgtcaaaacggacgttcgcaacatcaaaacaaagatcaggcgatgaaacagctcaaagcgaagctctacgaaatggaaatgatgaagaaaaatgcagaaaaacaagcgatggaagagagtaagtctgatattggttggggcagtcaaatccgttcttatgtgctagatgattcgcgtatcaaagatttgcgtacaggcgttgaaaaccgtaacacacaagctgtgttagatggtgatttagacaagtttattgaagcgagtttgaaagctgggttataaaagatgcgcattagatttactggattctagtagaaatccccgttctgaagaatggggaaaactttggatgctagagagattatgatattttaattcgtcgcaataatcactgcccttttcggtgcaggatacccttctatcgttttggaatgatcttgagggtcgaggaaatcaaccaacgattcattttctaaccaatctgttttacgctgttcttctaatgtggtgacggcttcatcaacacaacgaacatttttaaagccaactttttcaagccaattaatcaacgctggtacagacgggataaaatacacatttttcattttggcataacggtctgctggcaccagcacatcattaatatcaccgtcgataaccaaagtttctaacaccagctctccccctttgactaactgatttttcagttgggcaagatggtctagcggcgatttacggtgatacaacacccccatcgaaaataccgtatcaaaggcttgcaagggttgcatttgctcaatgcctaacggaattaaattggctctgcggtcgttatttaacaattttcgcaccgcttcaaattggcacaaaaagagttccgtcgggtcgatccccaccaccatttttgccccttcgcccaccattcgccacatatggtagccactgccgcagcccacatctaaaatcaagcggtcttttaacggtgataaatggggcaaaaccctatcccatttaaaatcggaacgccattcacaatcaatatgtacaccatacagatggtaaggaccttttcgccacggcataagctgttttaggtgatgtaccaagcgttgcatttcacctgcagacaacggctcaaccaaacgggcttcaaccttatctgccaaattaatttcacaaggcaaactaggcaaatggtctagcatttttgcccatttggcataatcgccgtgcgtctgtttttcccattgtttgagctgtaaaggaagtgtttccaaccaagcagataacggcgagggggcaatttgttgataaaaaggacgaaaatcaatcataatcttttcaaataaagtaaataagcggcgagattttaatgaaaattttcttgataagcaaaaacacttacctaaaaatagtcaaaaaagtacaggtatcatctacaatcttgattcaatattgtcattttcaaaaatttcgagtagaatgctcactctttttggtgctaggcttctgcctagttttttattcatacatatggtactagacagctgagtagtatgctctagtggcgatatggcttcgttagaggttttctataatgaaacaaggtattcacccaaattatgtagaaattactgcaacttgttcttgcggtaacgtgatcaaaactcgctcaacagcgggtaaagatttaaacttagacgtatgtggcaactgccacccgttctacactggtaaacaacgtgttgttgatactggtggtcgtgttgaacgcttcaacaaacgcttcagcattccaagcacaaaataatttgaaatttttcgggaaaacctccacaatagtggaggtttttttatgcctaaagaatgtatccagtaaaatgctactctgacaatgatatgataattaggaaagcaataatgaatcaaaagcaagatcttcaaattatatcaatacttgggcaaactcaaatcggatataccaaaccatttgaagattatttaaaacatataacacaaatattaaaaagaatagaaaatgatgaattttgggaggaatttaaatgaatgaaggattactatatagttttatccgctaccgcccttatattgaaacagaagaatttgctaatgttggtatcttaatctgtaatccagataaaaaagaattaaaatatcgtttagtagaagccaacaatgaaagagtaaatcacttttttaataaacaaaaaaatttcaatattatccgagatgttttgaataatgaattggattacattacccatcaatcttttgatctcaaagataatgatgaaatgattagatttttctataactataccgatagaaaagaaggagttatccaatatagctctccaaaaatattggtgtctgataattcagagatggaattggatagactattttctagttatatctaactcattcattgtattattgataccgatggtaaccctgaacgtttcaagcacaaaatgatttgaaatttttcgaaaaaagctccacaataatgtagtttttttatgtttgaaaattacgctaagattatgttagatactgaattacttgctttgatacaaaaaggggaagatagcaaattacagtttaaagctaatgttactcaccctgatgctttagccgctgagatggttgcttttgcaaactcgctaggaggaatcttacttattggcgtaaatgataatggtacattaagtggtctaactaatgatgatgtatttagacttaatcaacttattgctaatgtcgcatctcaaaatgtccgtccatcaatttctccacttactgaaaatattacctttccagatggaattgttatcgttgtccatatttccgagggaattagcaagccgtatatggattctcagggctatttttggacaaaaagtggagccgataaacgtaaaataacagctcgagaagaattattaagaatgtttcgtgaagcttcccttgtacacgcagatgaattacctgttactgggtcatctattcaagatcttgatgaagtttattttgatcacttttttgagaagttttatggtgaacccgtaactagccaacatttttctaaagctcaattacttgaaaatatgaatgtaatgaaaaagggtgaatttaatatttgcggagcgttattatttactaaagatccaagtagatatttaccaacatttatcataaaagctgtttcatttctaggaaatgatattacggaacaacactatattgatagtaaagacattcgaggtaatatcacggaacagttccgccaagccataagttttatcttaaccaatattcagcacaaacaaaatggacaaagttttaactctcttggagaacctgaaataccaagaattgtgtttgaagaactgattgctaatgcgatcattcatcgagattattttatttctgctccaatccgaattttaatatttaatgatcgtattgagattattagccctgggcatttgccgaataatcttacaattgaaaatataaaactaggtaactccaatatacgaaacccgattctcgcctctttcgctcctagagcacttccttatagagggctaggaagtagtatattaagagtattaaaagagtatcctaatgttgagtttattgatgagcggattgggaatgtgtttagggttattgtaagaagagaatgagctgtaataatcaaaatataagattttttcatctataaaatataaggataagattacaagtaaaataatgggatcatggtaaatgattttttgtaaaaactttactaattttatgaatttaaatatgagagatttttataattgaaaaaattaataaatcattgaaaacgggatttaccatccccttgaaatttaataatataatccaatctcaaatgagagaagtgcctacgatagatagtgtagcttctcaaaaatgaaatttatatttagaggatcttatgcatctccctttagtctcagttttaatttgtgcttataatacggaaaaatatattgaacagtgtataaactctgtaataaatcaaacatatactaatttagaaatagttattgtaaatgatggttctacagataatacaaaacatatcatagaaaagttagctaatcaagataatagaattagtatcataaataatgaaatgaacattggatatatatcttcattaaataaagggatacaacatataaaaggagaatatattgctaaaatagattctgatgatgtagccaaacttgattggattaaaaacattttagagaaaatgttggaagatcctacaattattgcaatgggttgctatctagaaatcatatctgtcaatggaaagctgggtaaatactataaaacaggagatatttggaaaaatgcactaacagatgctcatattaagaatgatatgttattctataatcctattcataataatacaatgattatgaaaagtttaatacataaaaaatatggtttaatatatgatcttaattatatacatgctgaagattataaattctggtttgaagtaagtaagttaggaaagatggcaaattatcctgaagctctagtttattatagattacattcagaacaaacatcatcaaatcataatgcctcacaaataaatactgcaaaaaaaattagacgagagattattacctactatatggaaaatctaggcttcgttaatataatagattttgataatatcaaatttagtgtacttaataagctcttgctggaaaaagatgtttggaatagactaacttataaagatatagaaaatcttaaaaaaatattattcgattgctttatgtctgcaaaagtagattcatacaccatatgcagaaccatttttactagtaatgccaaatgttttacttttaaacaaaaaattaagataataaaaaaaatgcttagaccatataaatatataagtaatatataataggagttatagatgaatattgttttttgttgcgatgaaaaatattccccctatcttgcagtaaatatattaagcattctaaaccatcataaaattatgatgaatttttatgtattggatttaggtatatctagtgaaagtaaagaatgtattataaacatagtagataatcatagatgctctatagagtttattcctataaatgaagatgattttagtgaatttccccaaacaatttcacatatctctaaaacgacatatgcaagattaaaaatagctgattatgtaaagaatgtagataaagttatttatctagatatagacttattaatagcaggtagcattattgatttatggaatataaatctagataaatatcatattgcggcttgttttgattcatttgttgaatatggtttggataattataaagcaaaaataggctttgatgaatctaatagttactttaacgctggagtattattaatagatcttaataagttaaaaaattttgatttatatactaaagccatagtatgtataaaagaatatccatatattgaatttcaagatcaggatattttgaatattatttttaaaaataaggttaagataattaacaccaaatataatttccaaccttaccttagatatcgaatattaaaaaaacagcaattgagtgatcaagaaagaccaaatttcccaatctctattttccattattgtggtgaagataagccttggcatagtaaatgcaatcatactaagtctcaattatttattaagctatttaattcaattaataataaaccacaacattggttaaataaggtagctcagaatgattatcgccaaattttcaagaaattaaaaaatgattttaaagatcgaataaaatttgggatatactaataaaaaacacacaaaaaaaagaatacctcaagccttatagtaaaagacttgaggtttaatgttattcaaaaggaataatacttttctgattttctagctctatctcttctattctctgttttttgcgtttatctctatttttatatctatctaattcttttagaatcttacctaatatactcattttttctttaggcttagttataaaacgttttgctctatcttcttcaatttgactatataatgagctttcttctttattcaattgtagttcttgaatacaaatagcaggagataattgatatataaataagttctgatctgataacaattgattaaaaattatttgatctataggcttaatatcttctgcttccaaggatttaattaatcttaataaataattaattgcatttttagaaataatatatcctgccgtaccataatgtttagatttaagaatacatatatttctaccattaataggagcaatattttgagctttttcactgattacaggcatcaaaaatgtttcaaaacgtactataaaattatcttgtttaatcatagaacctgaaatccaagaatagtcatttagaaaatattccgcatcttcacttaagataacatcatcttcaaaaatactaatgtaaggcatatcttcatcaatacacttttgccatagtaataaatggcttataagacaacctttctctccaactgtgagaacagtgttcttatttaattgtggcaatatattttctattatattctcttttcctagtggttgaaatgcatcaaaaaattcaaatttaatattcttagacgaaaactctttattaatatgtgagcgtcttatatcagctgatataagactaattatataattagttaccataaaactcttccgttaaaataaactttatgctaagatagcataaaaatatgttatttacaagtatgctatattttaaagttcttccttatttctatgattatggaaaagttttaataattacttgaataacaaatagagttaattcatattgaaggaaattataatggttaattatgtcattagtttaaaagattctgaaaaaagaagacagcatattatttctgaatttaaaatacataatatagattttgcattctttgatgcattatacccatctgagatacttaatgagcatatcaataactatcttcctaatttaaaagaaagttcgcttactgaagtagaaaaagcctgttttatgagccattatatgcttttattaaaaggtattaatgaaaattatgattattttactatatttgaagatgatattatcttaggtgaaaatagtaataaatatttaaataattatgactggtttgagcatttagatgtaagaaaagaatttattataaaattagaatcatttcctaaaaaagtaattaaaggaacgccccgctattctgtattagatagagagattttcaagttaaacagatcgtatgtaggagctgctggatatataatctctaagagagctgcagttaaagcagttgagttaatcaagcaattaccaccaaattcattagacgctattgatgaactcttatttaatcattttatcttaaataaagaactaactgtttttcaattaaatcctgccttgtgcattcaagaaagattttataataatgaagtatcagccttaccaagttatcttgaaactgatagagcaattcgtcttaagaaaattggtgagtatagaaagaaaaaaaatatactaaatagtatagctaaagaatttagaagatttgttgaaaaaattcgtagaagaactgttgaatttaaatagtgaaaaatattacatatgtatttgacatagaaaatgattatttttatgtatatttgtataacattgtatgttgaaatataaataaatggacctccaatcccttaaactttttttagacatcactcaaacccgtagttttattcgcactgcggaaaaaaactatatgagtgcttctaccctttctcgccatattcaacgtatggaacaagagattgggcagccgttgtttttaagggataatcggcaagtgattttgacggaagcaggggaacgtttttcacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgtgtacttgttgctcaaactgcgggtggtttagcagaatttctaaaaggctatgacaaagagccatctatcgtgttaggttatgatggacgtaaaaattcagatgtgtttgcacgtgatactgcagaaattatggcagcagcaggcattaaaacttatcttcttccaagaaaattaccgaccccagtgcttgcctatgcaatcaagtactttgataccacagcaggtgtaatggtcacagcaagccataacccacctgaagataatggctataaagtttatttaggtaaagcaaacggcggtggtcaaatcgtatcgccagcagaccaagaaattgcagcttgtattgataaagtagcacaaggcagcatcaaagacttaccacgcagtcaaaattacaccgtattagatgatgaaattgttgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgaaattgttgatgcctatattgcaaaaacagcaagccttgctaaagagccacaagttgatattaactatgtttataccgcaatgcacggcgtaggttatgaagtattaagcaaaacattagccaaagcaggtttaccgcaaccatctatcgttgctgaacaagtatggccagacggtacattcccaacggtgaacttcccgaacccggaagagaaaggtgcattagatttagcgattaaagtagctaaagagagaaatgcggaatttattattgcgaacgacccagatgcagaccgtttggcagtggcagtaccagatgcacaaggtaactggaaacctttacacggcaacgttatcggttgtttcttaggttggtatttagcaaaacaatatcacgcacaaggcaaaaaaggtgttctagcgtgctcacttgtttcttccccagcacttgcagaaattgcgaataaatatggctttgagtcagaagaaacattaacgggcttcaaatatatcggtaaagtaaacggcttattattcggctttgaagaagcattaggctacttagttgatccagataaagtgcgtgataaagatggtatctctgcagcaattatgttcttagatcttgtgcgtagcttgaaaaaagagggcaaaaccttagcagattatgcagatgactttactagagagtttggggcttatgtaagcggtcagatctctatccgtgttgatgatttatcagcaatcggtaagttaatgactgcattacgcaccaatccaccaagcgaagtgggtggtttcaaagtagcgactttcttagatcatacgaaaacagatcgccaaagcgatattttagtctttgtgcttgaaaacggcagccgcttaatcgctcgtccatcaggtacagaaccgaaaatcaagttctacttagatgcgcgtggaactgatccgaaaaatgcagaagaagtgttagcacagtttgatgcaagcatgcgtgcaattcttcgtcaagagcagtatggtaaacaagattgctagttgattaaaatgttaaagccagatagatagtaaaaagtgttggttttagtttttctattaccgacacttttcatatttccgtttaatattcattaatcacctatcaaatgtaatttttattaagaaaatgatgaacaataaattcaatcctaacccccctagttttaagtcagtaaaagcatgtcaacctcttaaatttaaaacgaaaaaatcttcactacaacaagattatgttcaaacatcaaaaaatgagcactacaaagacaaaccaagtttatcgatttatacaactgaagctaacaaatctagtaaagaaggctttgtaaaagtcagtgtaaaagacagaaataaacctataaaaagtaaaagtggtgccctatctccaagagcaccagaaaaaatccgtaataatcgagccagtgaaatgaaagtttatggagaacatgcttgttctgctatttttcaacaacgccctgaagctatcgttcgtttatggattacctctgagtgtgcccaaaaaacaggagcgttattaagctatcttgcagatcataaaaaggcatatcatttagtagatactgaagaaatgctgagagttacaggaacagagcatcacggtggtatgtgtttattagtaaaaaaatctacaccattctcgttagaaggctatttacaactggaacgacaacatgattgcttaatactattagatggtgtaaataatgctcaaaatatagggggaattatacgtacttgtgccttttatggaataaaaggcattattgtagaaaataatgacatactgaattcaagtaatgctgctcgtgttgctgaaggcggtctagaatttgtgtatcccttagagacaaaacataaacacattgccttaatacagttacgtaaggctggttatcaaattgtgcatttaactcgccaaaggcaagcaccacatttatctagaatagtattatctaaaaagattgtatttgttttaagtgaagttatatcaaatgaagttgaatatcctgaagatagtattgttcagctctcatttgctaattctctcaatagtgggctgaatgtggctgtaaatgcagggattttattagcgcaatggtatcaaaatcatatgttatagcgactaaatgattttactctaaagatagtcagagatgattatttatacttatgttgagtttaagcattaattatgtctatttgttcacataaaccttgcacttttctgatcggaacagaccgcttttttgcattctttttttgatacaacggagccattgaggtaaaatcttgacttattttgtaacgaaaagataacgataatgacaacgcaactttccttagagcaaattttaactctcgttaaagcggatatgcaggcagtcgatcaggctattcttgctcagctcaattcagatgttgttctgattaatcaactagggcattacattattagcggtggtggcaagcgtattcgtccattgattgcggtattggctgcaaatacggttggctataaaggtcaagagcatattacttgtgcagcttttgttgagtttattcatacagcaaccttactacacgatgatgtggttgatgagtcggatatgcgtcgtggacgtgaaacggcaaatgcccgttttggtaatgcggcaagtgtgcttgtgggtgattttatttatacccgtgcgttccaaatgatggcgagtttgcgttctcttgatgtgttacaagtgatgtctgatgcaacaaacgtgattgccgaaggtgaagttcagcagttgatgaatgtcaatgatcctgaaaccaccgaagagaattatatgcaggtaatttacagtaaaaccgctcgcctgtttgaagcggcaagtcaatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattgtatcaggtgcagaccaagcgactgtgattgcaatgcgtgattatggtcgctatctcggtacggcgttccaactggttgatgatattttagattacagtgcgaatgctgaacaattaggcaaaaatatcggcgatgatttagccgaaggtaaaccaaccttaccattgctacacgcaatgcgaagcggtaatcggcaacaagcagcattaatccgtgaagcgattgaacagggcggaaaacgtgaagccctagacgagattttggcgattatggcagagcataaatccttagattacacaatggaacgtgccaaacaggaagctcagaaagccgttgatgcaattgctattttgccggaaagcgaatataaacaagcgttgatttcattggcgtatttgtcggtggatcgtagttattaagtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatatattgtgataagaaaatataaatgacagaacaccaacctcaagaacacaaagaagcgttacaacaaaaacgcaaattaacccgtaaaggcaaagatccgaataccccttttgtgcgtgaaaaattagaactgccaaacggacacaacaaacttttactacactcttgctgtgcgccttgttcaggtgaagtaatggaagctcttcacgcttcagggatcgaatttgcgatctacttctacaatccaaacattcacccactcaaagaatacttgcttcgtaaagaagagaatattcgctttgcagaaaaacacggcattccgtttattgatgtcgatgacgattatgaaaacgaccgtaaagagtggttcaagaaagcagaaggtatggagtgggagccagagcgtggcattcgttgcacaatgtgctttgatatgcgttttgagaaaaccgccaaatatgcccacgaaaacggctatcctgtttttaccagctgtttagggatttctcgttggaaagatatgaaccaaatcaacggttgcggacaccgtgcggcagcggcttatgatgatgtggtttattgggattacaactggcgtaaaggtggcggttcacaacgtatgatcgaaatcagcaaacgtgaacgtttttaccaacaagagtattgcggttgcgtttattcattgcgtgacacgaataaatggcgtttagaaacagggcgacaacgtattgaaatcggcaaattgtattattcacccgattaaaaaatctccccctgcccctctttttcaaagagggggaaatttgcaagcggttaattttcaacaaatttttacaaatttaaaagaggaacaaacaatgtctaaatttgcaatggtatttccgggacaaggttcacaagcggttggtatgcttgctgatcttgcacctgtttaccctgtggtagaacaaactttcaaacaagcaagcgatgtgcttggttatgatttatgggatttagtccaaaacggcacggcggaagatttgggtaaaactgaacgcacccagcctgcgttattggcagcttctgttgctttatatcgcatttggcaagagaaattccctgagcaaaaacctgcggtaatggcaggacatagcttgggcgaatattcggcgttagtttgtgctggcgtgttggatttccaagatgcaatcaaattagtcgaattgcgtggtcaagcaatgcaaagtgctgtgccagctggtactggggcgatgtttgcgattatcggcttagataacgatgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcatcaaagcgtgtgaacaagcagcaagtgaaatcggcgaagtggtttcagcggtaaactttaactcaccaggtcaagtggtgattgcaggcacaaaagcagcggcagagcgtgtaggcgaattatgtaaagaagcaggcgcaaaacgtgcgttaccgttagcggtgagcgtgccttcacactgtgcgttaatgaaacctgcggcagaaaaattagcggcggcattgcaaaatatttcgttaaacgcaccgcttgttccagtaattaacaacgtggacgtagccgttgaaactgatgcagataaaattcgtgatgcgttagttcgccagctttatagccctgttcgttggacagaaactgtcgaaaaaatggcacaagatggcgtaacaacactgtatgaaatcggtccaaataaagtnnnnnnnnnnnnnnnnnnncgtattgtgaaagagttatcggcaagagcggtaaatgatgtggcatcgtttgaggcggcggtgttttaattaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctggatattttcccgtaccatttaaaatccccccctagccccccctttttcaaagggggaaatggttaaattcaattaggaaaaatatacatgcaaaacaaaatcgcattagtcacgggagcaactcgtggaattgggcgtgcaatcgctgaagaattagtgtctaaaggtgcattcgtgattggcacggcaacctcagaaaaaggggcagaggcaatctcagcttccttaggtgacaaaggcaaaggcttagtgttaaacgtggctgaccttacctcaattgagcaagtgcttgctcaaatcaaagaacagtttggcgacattgatattctcgtgaataacgcagggatcactcgtgacggtttattgatgcgtatgaaagaagatgactggttcgacattattcaaaccaacttaacatcaatctaccgtttatctaaagcggtattacgtccgatgatgaaaaaaggcggccgtattatctctatcggttcggtggtaggttcagtgggtaacccagggcaaaccaactactgtgcggcgaaagcgggtcttgttggcttctctaaatcactggctaaagaggtggcttctcgtggcgtaacggtaaacgtggttgccccaggttttatcgcaacggatatgacagacgaacttaccgaagatcaaaaaaatgcgatcttaagccaaatcccagcaggcaaacttggttcagcacaagatattgcaaaagcggtggcatttttagcttctgatgatgcagcatatatcaacggtgaaaccattcatgtgaatggcggtttatatatgaattaattatttcaaaaaataaataaaagctgaattttgtaataggcaaaattcagctttatttttatctattattgtggataatgaatcccttttcaaaaataaactagagaaatacattatggttaaaaatatctttgtcatcggctttatgctgtttgcaattttcttcggggcaggtaacttaattttcccgccgaaattgggtttcgatagcggagcagatttctggactgcaattttaggctttaccttaacaggtgttggcttacctttaatcgcaactatcgttgcagcttgctacgaaggtggttataaaaaagcccttgaaaatatccacccagcgatttcgttgcttctcttagcagcaatctatttaacaatcggtccattcttcgcaattccacgtacgggagcgaccgcttatgatatggcaattgtgccgtttgtaggtgagcctgattctacatcgctatttattttcacagctatctattttggtttagcactttggttaagtctaaatccaagcaaaatgatcgaccgcattggttcaattttaaccccagcattattaattctaattattgccttagtgatcaaagcgatagctctattctcaggcgttgaaacagcagaagctaaaaccttagaatcacctttaacaagcggtatcttagaaggctatcaaacaatggacgcattagcagcctttgctttctctgtgttagtgatcaatggtattaaagcaaaaaatgcaaatagcaacgtatctttagttaaacaaacgacttacgcttcttttgtcgctgcaatttcattagccgttatctatatttctatcggctggatcggttataaaattccattaagtgcagaaacagtggcagacgttgctgctaaagggcaaaacttaggggtatttattttaaatgaaaccacaacccaagcctttggtgaattaggtcgtaccgtattaggtttcatcgtaactcttgcgtgtttaaccacagcgattggcttgattgtatcaacatcagcttacttcaatagcattttcccgaaaatttcataccaagtttatgcggtgattttcacgttaatcggcttcggtttagcaaaccaaggtttaaatacggtaattagcaagtctgtacctgtattactcgtgttatacccgatttcaatgactgcattgttggtattattagtgaacttattcttcccattaccacgtttagcacaaggtttatcgattgtatttgtaacggtcatttcaatcttatctgtggcaggcgttgaatttattgctcaacttccacttaaagcctactcaatggagtggttgccatttgcacttgttggctgtgtgattggttatgtggttggtaaagtgaaaaaagattaattcatcttattttgttgtataggggcgttttcgccccttttttataaggaaaaacaatgccagaattacccgaagtcgaaacaagtatgagaggcatctcgccttaccttgtagggcagaagatcaaagagattattgttcgtcagccgaaattacgttgggctgtgagttcagagctttcaactatgcaaggggcgacgataattgagatttaccgccgagctaagtatttaattattcagacagataagggcgatattttagttcatttaggaatgtcgggatcgttgggtattttatcggtcaaagagaataaggcgatagataagcacgatcatatcgatctcatcacagaaaacggcgtaatcttacgttataacgacccacgaaaatttggaacctggctttgggcagagcaagctgaaacagcagagttattagcaaatttagggccagagcctctttcagaagcctttacaagcggttatttatttgaaaaaagtcgcaataaaacggttgctgtgaaaaacttcattatgaataacgctatcgttgttggtgtgggcaacatctatgcttgcgaatcactttttatggctggaatccaccccgaattagccgcacaaaatctaaccgcgaaacagtgtgagagattagtcactgtgattaaagaggttttgacaaaagcgattatccaagggggaacgaccttgaaagattttattcagcctgacggaaaacctggatatttcgcccaagtattacaagtctatggtcgcaaaggcgaggaatgtaacgattgtggctctattattgaagctaaggtaatcgggcaacgaaatagtttctattgtccaaagtgtcagagattaccgaagtaaatcacatagtagacaaatgtgttaatgttttacaaactatgcgtttaatcggtattatatagcacttgctacataacactgctttttatatggcatagcaaccattttgtctactattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatcggtggcaggcattgccacctttgcctttgctcaaaccttcacttgtagcaaacgcacctgtagccaaatggacagctgtgaagaagcccgtttnnnnnnnnnnnnnnnnnnnnnnnnnnnnnnngaccgcgataaagacggcataccctgtgagagtttgtgcggtgggaagaagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcttaaaccagtttaaaatccatttatctccctttctcataaactccgttgtgaagttaaacctttacaacggagttttttatgtcccaaaccgcaaccctttctgattttaacaaagcctttgatcgtgttattcaacacgaaggtggctatgtaaatgacccacgagatgcaggcggtgaaaccaaattcggtatcaccattcacactgctcgtgcaaatggctatacagggtcaatgtttacaatgactcgtgatgatgccaaacaaatctatttaaaagccttttggcaacgctatcgttgcaatgaatttccccctgagcttgcctttcagttttttgatgcctgtgtcaatcacggctcgggtaatgccagtcgtatgctacaacgtgctgtgggtgtcgctgatgacggcattattggtgagattacccttgcggcaattcgtaagcgttccaccgtagaagtcgttacccttttcaatgcagaacgccttgagttctataccaagctcagtggtttccaacacttcggcaagggctggattcgccgtatggcaggcaatctgcgttatatcgctgatgatgtnggagataaataatgaaaaaactcagcaacaacgctaaacgtagtcgtgcaaaaaatggcggtcgttacactaccgctgaagtgattttattagaacgtgggtggtattggtaatggctaaatttgcagaactctttactaattcggacggtcgcctttcgaccacaggatttatccagtttttcggggcgttattgatgtcagcgattttggcttattgtgtctatttagatcgcagttatgtgcctgaattatttatgacctttgcagtgttctgtggtggtcaagtggcaacgaaagggtttgcgaatgccttgagtagcaagcgacaaggagaatttgaatgatgacagtaaaaattgtgaccgtagtgttatttcttgctgcctgtgttttgttttggctttggctcaaagnnnnnnnnnnnnnagagcgaaatcggaaactacaggcagaaaaccaacaacaagcggtcgaaattcagcaaaaaaatgcagaggtacaaaatgcaaaaattcaacaaacgcatcgtgaaaatgttcagcgtgttagccctgataccgttgatgagcagttgcacgcacacaactacttccgtgacgacgacaggttgcacagcattcgggctgatttacccaagtcgtcaggacacgacggaaacgaaacgccaagtactagcacacaatctgacctatgaagaagtctgtaaggagcagtctaaatgacagagattctggatttcttacgccaacatttcgccttgatttctactgttattggtttagttggggctggattttggctaaaaatggatagtaagtatgccaaaaaatccgatgtgaatacccttgctgaaaatgttgaacactatgaccgacgtttaactcagcttgaaacaaaagtggataacttacccaccgctcaagatgtcgcaagacttgaaattttaatgacggaagtgcgaggggaaacgcaaacggctaatgcaaaaatgacttcaataaatcaccaagttggcttattacttgaagctaaagtattaaaggaatgatgtatgcagacaattttaactaaagatcaacgcttagtgattttacgttctcttgccgaggctggctatgatgccaatgagtctattttaagtgattgccttgatttatatggtcacgatattagccgtgatcttgtgcgtaatcaccttgtatggctagaagaacaagggcttattcagcttgagcgtttaaaagatggctatatggttgccagcattacgcaacgtgggttagatgtcgctcaaggtcgagtgacggttgaaggggtaaaacgcccaagacctaaggtttaaacggtttttaaaggatatttaaggagcgtttaaatgaatgagaaaacgacccgtgggcgtgcgagtaaagttgatttattaccgccgaacatcaaaagccaactggcaatgatgctgcgtgacaagcaatattcacaaacgcaaattctagaagaaattaacgatctgattcgtgattgtgggcttgatgaaagctattgtttaagtaaaacagggctaaatcgctatgccaaccgtatggaaaaaatggcaagtaaaatccgtaatgcacgagaagtggcagaaatttggacgaaacaatttggtgaagctccgcagtctgacattgggaaaatcgtgatggaaatggtgaagaatattgcctttgaaacgtccattagattgggtgaacaagaaggtggtattgagccgaaagatttagcattgttatcgtcagcattacaacgtttggagcaagcggaaagtttaagctatgagcgtgaacgtaaaatccgcaaggaagtgattgaacaagctgctaaagccgtagaagaaagtggtacacaagcaggactatcccttgaagatgtgacaaaaatggtaaaagcagtttatggcattgaataacaccgttctctatgactatcaaaagcgatggttaaacgataaaagccgtttcaaagtagcaatgtttgctcgtcaaacaggtaaaacatttaccactacccttgaaattgtactggattgcttagaagcagaagccaacggcgaacgtactcgctgggtgatcctttctcgtggagaacgccaagcgaaagaagcgatgaatgaaggggtaaaacgccatcttgaagcaatggggattgtttgcgaagtattagaagtgccttttaaagaagacactacgattaatgccctagaagtgatcttccctaacggttcaaaaatcactgcattaccagccaatcctgacacggctcgtggtttctcagcaaatgtgttcttagatgagtttggattccaccaagatagccgtgaaatttggaaagccctattccctgtaatttctgctggttggaaattgcgagttgtttctaccccaaatggtaaaggtaacaagttctacgaattgatgactgacttaaataatagtgaatggtcacgccactcggttgatatttatcaggctgttgcagatggcttaccacgtaatgtagaacagttaagagtgggcttaaatgatgaagatgcgtgggctcaagagtttgagttgaaatggttagatgaagcaagtagttggctttcttatgatttgattgatggtgttgagcattcacacgcaggattaccattccactatacaggtaacccgtgttttgtcggcgttgatattggggtgcgaaatgacctatttattatttgggttattgaactagtaggtgatgtattctggacaagagaaatcaccgctttaaaacgagcgagttttgcaacacaagatgctgagcttgaccgagtatttgtagaataccgtgtattgcgttgttgtattgaccaaacaggcttaggggagaaacccgtagaagatgctaaacgccgtttcggtgaataccgagttgaaggggttattttcacccaaacgaataaaatgatgcttgctacccttggaaaagaagtatttgaagataaacgactacgcattccgcagggagataaagtattacgagaagatttgcataagctcaaaaaggtgactggagctaatggtcagccacgctttgttgcagaacgagatagtcaaggtcacgcagatagaacttgggcttgtttcttagcgttgtatgcggcatctgatgtgaagcaacctgttgcaccactagcacgcaaaccacgtcgtagccagcaactttctgaaggttattaggatatgaaaaataaaaaagacttaatcagcgaaattgccactcgtgcaagaagttttgaccattgggcaacggggtatcatctgccgaaccctgatcctattctcaaaaaaatggggaaagacattgctgtttatcgtgaattactatcggatgggcaagttcgttcaggtgtccgtcgcagaaaggcggcaattaaaggcttagagtggcgaattacgaccacgaataatgaaaaagttgatgagcaactttatcaagtatttaaccgcttgccattaaataacatcatcaccgaaatgctaaacgcttcgctgtttggttatcaagtttctgaagtgatttgggcggagcgtgatggtttgattgtgccagctgaaattatcggtaaaaagcccgaatggtttgtgtttgatgaagacaatcagcttcgctttcgtaccaaggagcattggattgatggggagttactgcctgagcataaattccttttaactacgcaagaagcgacccaagacaacccatacggcttaggcgatttatcgctgtgcttttgggcggcaacctttaagaaaggcggttttaaatattggttagagtttaccgaaaaatacggctcgccgtggcttatcggtaaacaccctcgcacgacatcagagcctgaaaaagatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgaaaaagatcgtttggctgatagcctagaagcaatgataggaacagccattgcagttatccctgatgatgccagcgtggacattgtggagtccgcaggtaaaggggcttctagcgacagttacgagaagttcttagcgttctgtaaaggtgaaatcaatattgcgttattggggcaaaaccaaacgacagagcaagaaagtaatcgtgcatcggctaccgcagggcttgaagtgattgaagatattcgtaacgatgacaaggcaatgcttgaagccactttcaacaccttgttgcaatggatttgtcactataacttcaatgtcgagcagttgcctacatttgagttttttgagcaagaaagcataaataccgagcaagttgagcgtgatgagaagctacaccgaatgggtgtgcggtttacgaagcaatactttatgcgtgaatatggctttgaagatggtgatattgagctacaagcggtgagttcgacggtaaattttgcagaacatcaccatcacgaaacagaaatggatcggattgtcagccaaatgggtgaactttctcagtattcattaaacgctaatattgctcaagttagagcaagacttgataccgccgagagcctagaagaagctcaacaaattttagatgatattttgccccagttagattttagtgaatatgcacaactgtttgccgaagggctaaccacggcgacattgcgtggtcgctatgaagtgaaacaggaagccaagcgatgagcattgttgcacaacccttgccatttagtgagcaaattgaatacttccgtaagaaagtaaatatcccaacagcaacctaccttgatatttacggcgaagcccacgactatgcttttgtggttgctggagctcatacacaagaaatcatcggcgattttcgccgtgcgatagatgatgtgattgatcgtggtggcacattagaagagtttcgtaaggtattcgatgccattgccgacaaacatagctgggaatataacggtgggcgaaattggcgtagccgtattatttatgacactaatctttacgccagctataaccacgggcgttatatgcaacagcgtgaacttgctgatgtaatgccttattgggaatatgagcataatgactcagctcacccaagaccgcaacacgttgcgtgggacggcttagtattacgagcagatgatccgtggtgggactatcattatccaacccgtgcatacggttgccattgcactgtgcgtgctttagatgatgtcgatctcaaatatcaaaataaaaccgtgcaacaagcccctgaaattgagtgggaagaaaaggtgatcggacagcgttcaggcagtccgagaattgtgcgagtaccgaaaggtgtcgatccgagttttgaacaccccaaacgccttgtgcctgtgcataaggtagatgaaattttaatgcagaaactggttgaggctccaccgcagtttgccagttctgcggtgagtaatgtcttgaattatgcccctgcgttagccttattaaaccgttcaatgaaagagatggtggacacggttgtcgcagataaaatggctcgtgggcagatgaaatatgttggcgttattccccgtgatgtagtgaaaaaactcgaagctatggagcttgcgccgcagacagccgtgattgcggtgcgtgatgacgatattctgcacgccttgcgtgatgtgaagcaaggtaaagggataaacctaccgcttgagttttggcaacagttgcctgaaaaattgcgtaatccgaaagcgattttattagatagttctcaaaaacttaatgcactgttatttgtgtatgaagaagatggagccaaaataatcatttcaatggactataaagtacaggtgaaaaacagtgttacgaagaaaaaggaacggattgcactgaatatggtgacaactggcacaaaaattagcaatgctcgtcaatgggaaagtttgaaaggctatgaagtcttatggggtaatttagagtagtccgcaggtttgcctgattcgaacaggatcatacggtagttgcctagcgtaacctttccagtaggaaaccccctgcggatagccaaactatacgcctaaactattttttaatcaataggaataataatgatccatattaaacttgatgctgaccaagctctcaggggcttacaccgtacagcccaaaacttgcaacagggtaaaaagctctttggggtattaggtgaaacgttacgttcaattcacaaagaccgttttgagaaagaacaggcttcacctgatggagaaaagtggactccattatcggcaaagtatcaggctaaaaaacgtaagaatgccgataaaattttaattcacgatggctatttgaaaaatctacttcgctttcaagcaaccaatgaaggcgtaacctttggaagtgaccgcaagtatgctcgcttacatcactttggcagtaataaagccagtggcaaaggttcaggtatacctgctcgcccttggcttggtgtaagcaagaaaaacgaagactacttactggcaaaaacagaacattttttacgaaatgtgattggcaatagctaaatttcaaaaataacgcctaaaacgcccgatttagcgttttattcttttttcaataaatgatagctcgatacaaattcaaggcgtttataaacacctgtaaacgccttaaatcgcatattacacttctcttacttgtctattttatttttgcattccttaaactagtttaaaagccgaaaacactctcttttttcataatgcttatcgaaacggaggcattatgaacctaatcgaaatcttcaaagctggcactcgtaaagatgccaatggcacagaagtcactattactgttgccgacctaaaacaagccgtagaaagctataacgtggaatttcacgaagcccctgcggtgattggtcaccctgaacataaccaccctgcgtatgcgtgggtgaaacgtctagaactggaaggcgatattctcaaagccgaacttgaccaaattgaccctgaatttgccgagatggtagataagggacggtttaaaaaagtgtctgcgtcattctatctcgccaatagtccgaataatcctaaacaaggctcgctctatttacgccacgttggttttttaggggcaatgccacctgcagtaaaagggcttcgcaaccctgtttttgccgaaggcgaagaaggcgtagttgatttctcagactggacggaagcaaccctatggcgacgtttgcgtgattggattattggcaagcacggtcaggaagaagccgataaagccctgcctgattatttggtatcaagcattcaagaagatgccgtgcgtgaagatatgaaacgcatttatgaagcccctgagcctaaccctatttttaatgaaccaaagaaacctgaaggagaacgtcaaatgtcaatgacacccgaagaaattgcagcaatgcaagccgaaaatgcccagctaaaagccgaaaaagctcaagctgaagcagagaaagtcgccgaaaaactggaagcaaccaaggcggacaatgcgtccttttgtgaaaacttagtcactcaaggcaaacttgcccctgttgcaaaagacgctgctcttgccttgcttaactgttcggcaacgatggcaagcggtcaagtcgtgaattttaacgaaggggaatctattcacagcttaaccaaaaagttcttagaaacccaaccgcaagtggtgcagtttggtgaagtggcgacgaaagagagagcttatgacggtgagcctgataccgtcagttatgctgaaggaactgatccaaattccattgaagcagaccagaaaattcgtgcttacgccaaagaaaaaggggtgagttacaccgaagcatttaacgctatttacaaataaggagccgaaatgactactcataatttacaaaaactccgtgtgcaagaccctgttttaacagaactcgcacaaggctatcacaacaacgaacttgttggcgaaaccttaatgccaacagtagagatcgaaaaagaagcaggaaaaattcccaaatttggtcgccttgctttccgtttacctaccaccgtgcgtagtttgcgtggcacatctaaccgcttagatcctgaagatattacagcgattgatgtttcactcgaagaacacgatgtggaatatgccattgactatcgtgaagaaaatgaagcgattttctctctccgtcaatttgccttaaatacaacgcaagatgtgattgctttaggtcgtgagaaagaagtggcaacgcttgctttaaatgaaagtaaatacgataccgcaaacaaaattgcattaagtggtacatcaaaattcacccataaagatgctgatatttttggcatttttgatacaggtattcgagcgattaaacgctctattgggcgtaagccaaatgtttgtgtgattgcaggtgatgtttgggctgcacttaaagagcatccaaaagtaattgaaaaattgaaatattcacaagttgctatcgtgacacctgaagtgtttgcgaaattgattggtattgataccgtcaaaattggtgaagcagtctacgagcacgaaagccaactcaaagacatttggtctgatgcggttgttttagcttatgttgccccacgctcagcacaaggtaaaggtacggtttatgagccatcttatggctacaccgtccgccgtaacaagggtttatttgtcgatacatataaagaaaacggtggcaagattgaagtagttcgtaccaccgatattcacaaaccacatttagtaggggcttctgcaggctacttaatttcaaaatgtatctcagcctaagtgatggggaatttccccatcatactctgaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaaacaaacaatgaaagccaaagtaaaacatactgcattgttacataacggtaaacgttatgaagtaggtgatgatattgagctgaccgaacaggaagctaagggtttagcttattaccttgaattaatagatagtaaagctgaagaaaacaacgtagaaaccactaaggtggaagatacagcaaaggctgatgaagctacaaaagtacaagctgaagctaccgctattgccgatgagttagatgctaaagaagcggaagctacggaaaaagcgactaaagaaaaggcaaaaaataatgtacatcaccgctgatgagttaattggctcttttagtaagcagatcttagttcagctcagtaatgacgaccacagagcgacggacgtgaatatggctgtggtggaacaggcaattcaaacggcttgtgaacgcattgatacatctctgcgtagccgttatgccttaccccttactcaagtgccaacaatgattaactcgcacgccttgtaccttgctcgtcactggctttacgctcgccgtgcagaaatgaaaatgcctgaaacggtgaaggacacctacgctcaagtgattaaagagctagatgccattgctaaaggtacgttacatcttggtttagccaatgcagaagatgtgagtgaaacaggcgatttattgcctgatgtaggtgaatatgcggtgcgagccaaacagcaaatagatacagggggttactaatgtctgccaccttgccgattttgaccgagtttgaaactcgcttgaaaacgcagtttcccgattgggatattcagctaatgcctgatgaccctagccactattttctgtcgcacccaaacggtgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgattagttatgctgggtcaaaatttagcgagccacgctctacgtcggtaattacgcaaactcgcaaggtgcatattgtctttacggtgttaagtcgcaacttgcataacgactttggtgctttgcagtttttagatgagttacggctttccgtagttggctttcaaccgatagactgtacgccaagctggttagttgaagaacagtttgatgagcaagatagcggtgtgtggatttaccagctggttttagccacagaaacgttgcaaattcaacggctacaagcggtcgatttagagccgaaatttaccacgtttattgctagataagagcatcagccccttgatgcccgtttaaaacccaaatcataggagaatattatgtctcaattccatcacggtacagaaaccaaacgagttaaaggcggttctgtgcctgttcataccgtcgatggtgctattatcggcatcatcggcaccgcccctgttggtgcagtgaatgagctgaaattgtgtatgaccaaaaaggattttgcacaattcggcaatgtgttagatcgtggctataccttgccaaatgccttagatattattagccgttatcaagcagggcaagtttatgtggtcaatgtgctagacccagctaaacaccgcacgacggtttcaagtgaaaatttaaccttagataaagaccgcctaaccgcaaccttagcatacgctggagtgattgaattaagtcttagtcatagttcaggctcgctgacaagtgggcaagattacaccgccgatttattgacaggtgaaatcaagtttcatcgtatgttagaaaatgtgactgcgacttatacctatgcagacccaaccaaagtcacggaagcggatattaaaggtgcgattgatacaggcacaggcaaacgtacaggctttgaaatgttgcgtgctggttttaacttgtttggtagtgatgccaagattttactctgcccacactacgacactcaagcaacaatggcaacggcactagaaaccctagcaagccaactcaatgcgattgcttacatccaagctccacaaggcacaacccttgcaaaagccttagcaggacgtggcacggaagggcaaattaacttcaagacttcaagtgaccgtacacatttattcttcccacacgttgtgggtgagcgtaatacccttgaaagccttgcgacccacgctgcaggtttgcgtatgcgaactgacgttgatttcggctattggttctcaacatctaatcgtcaattaaaaggcgtaattggggttgaaattccgctgaccgctcgtgttgatgatattcaatcagaaactaaccgcttgaatgcggtgggaattacgacggtatttaacagctatggcacaggcttccgcttgtggggtaaccgcctagctaattatccaacggaaacccatattgtcaattttgaagtggtacaacgtactgcagacttaattgatgaatctcttcgtcgtgtagagtcgcaatttattgacttgccgattgatgatgccttgctagattcattactaggtacgattgaaacctatatgggtacattacgttctattgttggttttgaagtctggcttgatcctgatgcggatttggttgatgcctttagtaaaggcaatgtgccgattaaatataagttcacgccaaaaatcccagcggaacgcatcacgaatacgtccgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcaaccgcttggggttctgtgactacattctttagtaatttatggacaacattatcaacttcagtaacccaatttattagcacaataggtcagacaatcctgaattttaatccattggcactcttccagactgcattctcaacagtgctgtcttggtttagcattgatttaccgatgcagtttagcaattttggtaaaaatattattgacgggcttgttggtggtatcagcaatgcgtggaatttagccaaagaaaaagtcagtgaattaggtagtggcattaaaggttggtttgccgaaaaattagggatccattcccctagccgtgtatttaaaggctacggtgtcaatgtagtggaaggcttagtgattggtatggataaggctcaaccccttgcgactgaagccagtcaacatctttccaatgcggtgacatttgagcctgttttaaatacggttgaaacgatgtttaaaccaactttaagcaaggaaaaaggcttctttggtagtttatgggacgatattcaattcggggcgaatatggttggcaatctattgggcttaaatcaacctacggatttacgcacgccgtcttttaatcctcaagcaaaagacggtggtttatttgcagattatcaacccttaaatagaaatgaagtagccaataccgcaacaactcataatcaagggattacggtgcattttagccctaatatcacaattactggttcagcccctgcccctgatttaaaagaacagttattgcaagcgttaaatgaccctgcaatgttatacggcttggagcaactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttaatcgagtaaacgaccaatttggacggagagcttactaatggcaaattacgcattacttggcaatattgcctttgatttattaaatgccccatcagcctttgatgagcgtcgttcggcaacctttgcagaacacgctgtgttatcgggtaagccgaaacttcaggcaatgggcgataatcttaccgatattaccttgcaactgaagttacatcatcaacttgccccagtggagcaacgctatcaagcgttagttactgcaaaagagaaacaggaagcccttgctcttgtgttaggtttttcacggttcaaagggcattttgtgattacagatttgagtagctccgtcctatttagtgatgccaaaggcaacgcccttgcccgtgaagtgtctgtgagcttgcgtgaatttgttggcaataccagtcagggcttgttgggttctgcgttgtcaattggtggattatctccccttgcatctattttgccgaaagagctgacccaatttgtcagtaaaacggctcagctagtcaataagggggtgcaagtgtatcgccaagcacggcaagcgattgatgatgtccgcaatacggtagccgttgtgcgtgctttagcccataaccctttagaagccttaacacaactgcctactttattgggtagcttaggagcatctactcaaggtttggctgagatggtggggcttggtcatagctttggcattcttacacaagggataacaggggctatgccgtttttaaatggtttggtggaactgagtgagaccttgcgtaccgctcaaactgaatttggtcgtggtttggggcagaataatttgggaacgtggtttgatctaggggtgaaggcgattgatgaagctgatgaaattgctcaatcaatggcaaaacctgtagcacatctaaccgcttggattgctttacgcagtgatacgccacagccgaaggagaatgttgatgagtagcgtaattgaacatcaaattaaggcaggcgaacgttgggatttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttatcgctattacggtgatgtgggagaaataagccgtttaatcgatgctaatccccatattccgttttgtgaagtgttaccgatgggacagacgttatttgtgcctgtgattgcggttaaagccacgtcgcaggcagatcttccgccttggatgcaggagtaagcaatgcaagtacaaacgcccacctttgagctgttttacggcaaaacggccattacacataacatcaagccccatttgattagtctaacttatacggattatttaagtgaccaatctgatgagctacaagtcacctttgaagatattgaacagaaatggattggctcttggtttccgacccaaggcgatgaactgaaactgcatttagggtatttgggcgagtcgttagtcaatttaggttcgttcgagttagacgaaattgattggtcaaaagtcaaaggcagtggttcggtggtgactctacgagccttagcaacagggattagtaaatccaaccgtacgttaaagcctaaagcctatgagaacaccacccttgcggacattgtgcgaaaagtggcaaaaaatttgaaacttgatgttacaggaacagtcgccaatatcccaataaaacgggttacgcagtatcaagaacgagatgttgagtttttaactcgacttgcccacgaataccatcacagttttaagattgtgggtaaaaccttagtgttcaccacaatggagagccttgaaaatcgtccacctgtgacggtattggatttttcacaagtgctgtcgctacggcttcgagatcgtattaaagatgcggtgcagaaggttgaagcggtaggactgaatgccgatagtaaaaaaacggtgaaatccgaaaaaagcagtaagcctaaacgccctacgaaaaagcaatctaaagccagtaatgctgacaccttgaaaattgtgactcgtggcgaaagccaagagcagataaaagctcgtgcagatgctgctcttgctgaacagaatgatgaccaacaagcaggcaatattcaggtgattggcaatcctaagttagtcgcaggtaatacggtgttattgacaggttttggtatgtttagtggcaaatacttgattaaatccgctcgtcatagttacaccaaaagtcagggatatgtgactgatcttggtgttcgaatgttggaatttattgaagatttaccgaccgcaagcggtctgatttaacaggaattttgcaaatgaagaaagctgtcgttacccataactttggggcaacctatcaagaaggttttgtcagtcaagtcgatccgaaaaatcaccgtgtcaaagtcaaaatcccaacgctagaagattttgaaacagcgtggttgccattttttactatcaatgcaggcggtaatcagttttacggtttgcccgatgtgggcgagttggtggcaatgattttagatgcaaggggtgaaggtgggtatgtgcttgggtcgatttataatagtgaagatccaacacctgttacagatagtgaaatgtggttacataaattcaaaaatggcacggaaatttcccacgaccgnnnnnnnggcgatgtgatagtcaaaaccagtggtacagtcaccgtcaccgcagctcaagcggtggtgaatgctccgactgaaatcaacggtgatacagttatcaatggcagtttgcacgccacaggtgctattacctctgcgaccgaagtttctgcaccaagtgtaaaacaaggctctgtttctctgggttctcacgttcatactggggtggaaagtggtaataaaacatcaggtacacccaaagcctagtcaatctttaaagtagtttaaaagcccatcttcatcatagccgttacactcacggctatgaatacacatacacttcaacatacacattggcaaattgcccctgaaggcgttgagagcattcagggggaaggtgatttacaccagtgcattattaacatcctttctactcgtaaaggaagcgatgtattgcgccctgattttggctcaaatcattttgaatatattgatcagcccttcgatattgctgtaccaaatatggttcgggaaatttttgtggcgattgataaatgggaaaagcgcgtggtagtacaagaagtgcaaattagtggtgaagcaccgcattttttctttaatgtgaaatggtgtgttgctgaagatattgaacgtcaaatttatgcaacggagtttgattatggaaataaatagtcgttatgacattaccgttgtgcctgaagatgttaagcagattcttgctgagactatcgcaaaatatgaacaagatacaggcaaagtattacaacctgctcatattgaacgcttgattatcaacgtttatgcctttcgtgaaatgttggtgcgtaaagggattaacgaagcatttcgtcaaacctttccgcaaacggcaacggggattgcgttggatttgtgtggtgaaacattaggttgtcatcgcttaaaagacaaatcggctcgttgtgttctgcgatttagtgtacaaggtgaacactcgtctattttaattcctaaagggactcaagttgctattactgatgatctgtattttattacgctaaatgatgatgtgattacacctttgatttcttacgttgaaattgaagcagaatgtaataagaaagggctgattggtaatgaatgggaaattggtcggattaaaaatctcagaacatcacttaatacgaccgccacacttgaagtcactaatattgatagacctagtggtggtttagttgaagaaaacgacgatgactaccgcaagcggattcttgcagcacctgaagcatttagttcttgtggctctattgctgcttatgactaccatgttagagcggtgtcgcaagatattgccgatgtcaatattgccacccctaaaggtgggcttgttcgtatcacggtattaactaaaacaggcttacccgatacacgtttattaaacgacattaaaaaatatgttagtgcagagaaactacgcccattgtgcgataccgttgaagtgattgcgccgaccaaacgagattatcaaattcaagcagaattgattttacttgatggttatcgtgaagatattgtgaaaaccaaggctcgtgatgcaatgcagttatatctttcagataaaactaaaaagctcggtatggatattgtaccgagtgccattatttcggtattgcgtgttgatggcgtatatgatgtgaatttaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgacaaaaacaatcattgctgaaaatgaatgggcaaactgtactgcattgcgaatcgaagtaaaagaggaacgcagtaatggctaagttagtgtaccccgacatcattgtaaatgaccctaaatatgtggctttagcaaatttgagcaatcagttagatcatttaaaccacgctcaaattatgacaacgattgtggaattattaggtgatgaatttattccactgttggcagagaaatggagtgtcacaggctatgacggtgaatttattgcagaagataacgactctaagcaggctctaattcgcaatgcgattgaattacatcgtagaaaaggcacacctaaggcaattcgagatgtattacgttcgctaggttttggggaaattgaaatagatgaagggctcaaggacagaatttatgaaaattctaatgtcgtcaatataccagcagatgaacgttgggctcattatgctattcgcttaagagaacctgtcactaatgatcaagcagtaaacattcgtaaggttttgagaaattttgctcccgcaagatgtttattggcagtacttgattataaatctgtaccgatcaggtataacagtaaggctcgttataacggcaaatataaccacggttcaaattaattcaacaaaggacaaaaatagaaatggcaggcttaaacgaaatagcgaaatgggaaagagaagtctatcaaattgaggaagacgatcctgtgcttggtggtgtgaaaggagtgactaacaagccccttaagcatcttgctaatcgtaccttatatttaaaacaagtccttgaagctgcaggacaaaaactgatacctaaaaaactgacagcaaccactcgcaacaccgctgacagtacagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgcaaaagcaggtaaagctattgctcagtctgtggcacagttgcaggttaatactaataatgcactaaatcaaaaagtcaataaaacggatatcagtaacgctgtcaattcaacatctcaaactacagtggcatcgtcacaagcggtcaaaacggcttatgatttagctaayagtaaatacacrgctcaagatgccagcccaacccaaaagggcttggtgcaactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttagatacatcgagccaatggtgctggagacaaacttttgatttgcctgagaagcaatatacatttagtgctgaggtcaaacccgaaagaactgsgttttatctccatctgtacaatgggaagagctgggttaattttyatkcaagaaatttgactccaggcatatggcaaaaaatatcgattaccttcgtcagtgcgataasaaacatttcattcattaatccaggtsaaggrcttrtagaattacaaaatcctatgcttgtcgaaggcaatagagctatgacttgggctccagcgcccgaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagcgcccgaagatttaaccgaagaagcgcttaatagtgcmcgtcaaaactatgttgccaaagctggggacacaatgacwggtccattgaatattaaccacgcgarttcgtatctcagaggaaagaacaacggcgttgatgactggtttgttggacgagtcagaaataatgataacgatgttgcactggtatcctaccagtataacacaggtatacacctcaagtccgacagagttgaatcgaacaaacctatctatcgaggcaatcacctcgtgtttgacgaaggaaatttgcttcccgttcgacagattgatttgcgttctattgctaatgggcaaatatctttccaagatgctacgcctgcgcagttaccgcttggagctttcgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaataccattgagctggccaatctcagtgattttatctatcaaaaaatcggcaattttgaaattcgyaaataccctgatgggatgatgattcaaacctatttttatgatgtaaatgatttgaaagaatggggagaaaagcaatttacttgggctgtcgcttttgctgataaacctatggtgatacctaaagtggagcatacctatggtataaacagcgatgttggtagtgctattatgagaaaaagcaccaatgctgtttgttattataaattatatgaacacaacagtgagaatcaaggtgactgtcgagtgcaatttttaggtgttggtcgctggaaataggagaatacaatgacaattttttataaaracggtttttataacaacgaccacgrcggytttgtaccwgarggsgcttgtgaaatttcggmagaaacctaccgcttgttacttgaagggcargctcaaggtaagytratyattrmygatgrtgaagggaatccgattttaagtgagccaccgccgatacctattgaagaacaacgccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcttgtcagtcaaagcgacgtttgacttattcggcgaccaagaaattccgtggacgttcgccgataattcggtggcaatgattaacaaagannnnnnnnnnnnnnnttggcaggtgttaatggaagccaagactggcaatcacgctaatgccttgaagcataaggcgatggtggaacaagtagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagggctggcgatttagtccgaatcagttggctgtgattttaaataaaaaggagatgttgcgataatggaaaaagagcaaaaaaaactatgtcaacttttaaacaagccccattgccttttatcgggcaaaaaagaatgttyttraaacattttagtcaaattttaaatgataatatcagtggagacggcgaaggctggacgattgtagatgtgtttggtggtagcggtttgttatctcataccgccaaacaactcaagccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttaaacacggcaaactggtgctggaggcaaggtgcaatcaatgcacacaatccaagcagtatctattgcgggcaatagaaaagcacttgcgggtatctctttaggtgcaaatggaggaactgaaagttctgtgattgtgatggccgataaatttaacgttgtcaaaaatgcacgagatggcaacgttaagccaatgtttagtgttgttaataaccaagttgctgttaacggtgatttgattggagatggcacagtatcggctcgaatgatggcggctaactcaattgctgctggggctattcaggggggagcagttcgcgcaaatcatgttgcggcaggggagatttctactgaaaaactggcttcagaggcagtcactaccgagaaaattcgaagcaacacaatcacttccgataaaattggtacagggcaaattatcacaaatcacatggtggctgggtcaatagatggaaaaattcttcgtgcagggacggtaacagcagataaagtggtagctagagtctccctacaatcaccagtgattcgaggggggattttggaagttgggagccttattggtggtaacctctatgaggttaaatctttcacaccggctggtcgaaatcaaatgagcattacgatcaagccttcaatagcacaacgattactgaaaatgacttgggattatggtactgttagattttcaggtaattctgctgctattggtggtactggcgattgggtaacaagcataaaaaattcagcaggtactgtatcacagcatttaaaaggattttacacgctcgttatcccatctaatacacaggtaacgttatctttaacatttaataccacccgtataatgaatcaaattcttgtagaaacagttgtttattctgggtcaagttatatacaataggtcataccttatgacatagggggaaattatgaaaatcttgtcttcaatatcgatgattgctttaggcgtaacattgattggttgcggaagtggtggaggcggtggagacagtagtgcaagcaatccgccctctcaagttccgacaaagaccgaaccgcaattacccacaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatctcaggttgaaagtgaatggaaagctaagataagggaggcgaagttaattaggatcgatcatgagacacttagactttctgacgatgtggcttttccatctcagatatttaatatggcagatgagaagcttggtaagctagaacaagaattagggcgtaattgggttctcaaagcctacaacttaccttattctgcagttggctatgtattaccagcagatgtctcaacagatgaatatggacgtgtcattgatagccgagcgaataattatatggctgaagtagttggtgcgagaacggaaatattaccaaaaggctcagcgtactatgaaggagtttcttttggtgcaaattctgagggtaaattgaagctgtccataaacttctcagacaagactatttctggttcggtgactgatagaaagctacttagcacaaaagaggcactagcagatattagcttgaaagaggcaaatatttcagctgttggagaacaccatttttcaggtgttgcggaatcccaaggaatacaaggtagctactatggctcatttttcggtccaaatgctgaagaagttggcggcatcattcgagatgatgctggcaataagtatgaaggattttctggcactaaataatttcagcctcttaacgcaaaaaaccttgatagaaaaaactatcagggtttttctttttctaaaacaaaccaaaggagtcttatatgcaaaaagatgtgaaataatggtgggtattttagatggggaatctctgtaagtctttgttttaattaaataaataaacgccttttattcgatatgtattgcccttctaaggcgtgggtcannnnnnnnaatcctttagggcgtgccatttaacaaatgaatcttttaagttcacctcctgagtttgataaaataagcaaaacccagcctatttaaaggtggctgggttttgcaagtgatgtactaattgcgaattttattgagctaaacacacaccaaattgatccgccaaagattgtaaaaattctggataggcgtttttacttaattcaatttttgcccctaacggatctaattgccctactttggctgatgtgcctttgcttaagctctcaatcacttttggcgtaaattgtggctctgcgaataaacattgtgcttttttctgagcaatgcttttcttgatggcatttaaggtttttgccccaggtgcaacggttggattgattgtgaatgaacctaatgatttcaatccataagcctcttcaaaatagccgtaagcgtcgtggaaagtgtagtaaccttttgattttacaggttctaactgttttgcaatctcgctatttttcgttgccaatgtcgctttgaaatttgctaaattctctgcaatttttgctttttgctcaggtagttgctggcttaaacgctcagcaatttgttctgcgatatgttcacttgctttaggtgataaccaaatgtgccaatcttcgtcgtgactatgtccatcgtgactgtggtcgtggtgagcgtgattgtgggaatgtttatgctcgtgtttgtgatcgtgtttatgatcgtgcttgtcttctttttcttcacctgaatgctccacaagctctttaattgcaggcacatcttcaagggttaagactttctcttttggtagtttttcaatacttttctctaaaaaagtttccatctcttccccaatccatactacgagctgtgccgattgaagttgttcaacatcagagggtttgaggctgtaatcgtgtggcgaagcactggttggtaatagcactttagtttctgtgacaccgtcggtaatcgcattagcgataaaacctagtggtttgactgtggttaaaacatcggcattggttactgcagttgcccccaataatgcaaggcttaataaactttttttaaacatagaagatctcctctcaaataaagcggtgagatcttagcagaatattgcaattaatctataatttttttatggttattagcattaatcacaaaaaaataaggacacccaaaagcgtccttataaaactgacggtaaaactacaacaacatcttcacaatcttatccaatttcacccgtccaaattttttcagtaattttttcaccttttcggggtaatcttttagctcttctaaatcgctataatgggttaagactgttgtatgtgtacgaatttgtgctaactcaccttgggtcttttcactcagctcaccctttggatcagaaatcaacacggcattttctgcatctaatttccacgcacgtgggttgagattgtttcctgtaagtagaatataacgctcatcaatccatacgccttttaagtggtagctgttcttaccatctttccacaagcggatcgttaattgcccattttggatataatgatcaaactttttcgtaaatgctcgcagatttttttcatacagatacggcaaagcggacgccatcgtaaatttttcttcaggtggcgtgaaaaagtcgtttgctgttttatcaccaacaataatttcaatctgcttgccattgtctagtaaccaagcgatacgttggctgatagaacgtgggaaattgaagtacggggtgcaaatggttaatttctgctgtacttggaaaaatagtgcttcaatcgttttattcagcggatttttacgccctaagcccactaaaggtgaaagcattagttgggaatgatccatcgttctaccgttaaaacgatattcttgttggcttaattctttacgaaacgttttaacaagcggtcggatttcaatggtttttggacgatttgcttgatccaagcgatttaccgcagggttgctcaaaatattctgctgaatgaaattgacccagctgtctgccaaagttttattttcaatttgatgataacggtcgtaacgataacgctcaaactgctgtaaatagacgttgttgatgctcgctccgctataaagcagggtatcatcaaacacaaaaccttttaggtgtaacacaccgaagatctcacgtttattgacaggaacgccataaaacgcaatctcttgctccgtcggcaaggcatattgctcacgcatctgggtgtaccagtcggcgtttgaactttgggttgcttcgccaatacgtccacgttgagccctatgccaatctacaaggattttgatttccaactgtgggttagctaatttcgcttgataaagtgcatctaagatctcttgcccagcttcatctttttcaaaatagagagcggtgagataaatgcgacattttgcttgttttattaacgctaaaatgtgttgtttaaactcagtgctactggtaagaaaatccactttttctaccgcttgggggataaaagtgagattatctaagtggcgttttgcacgggtttgtttgtttagaataagcatcttatgctccatttttctttacttcgtagatagtttctacgcagtaacactatccctacttttcttttctttgcttcgccaaagaaaagtaggcaaaagaaaggcgaccccaagcgtttcttcttcctacgcttgttgctaatttttgggacgaacttttcaaactcgcttgcttcgcaagctcaaacacgaaaagttgtcctcaaaaattgacgcaaccgcttcggcgaaacgcaggggaattgatcgaacatctcgatctcaactttgcaaaaaattaactaaaacttaccgcttgtttggcggtttgggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattaagcgatgatgaaactacgcaaagtttcttgtttcaccttccccaaccacattctccacacaacgcccacaaatttcagcgtgttctgcattcgcaccaatatctgtcgcatagtgccagcaacgtgggcatttttcaccgtctgcacgttctactttcaccgcaagaccagctaattcgccttctgcaacatcagattctgaaagtggtttaacaatcgcttgtgaagtgattaacacgaaacgtagctcgttgcctaactgttctaacagtggacgaatatcatcatttgcataaacggtcactttcgcttcgagaccagcaccaattaacttgtcgttacgcgcttgttccaagacacggtttacttccgcacgcacttttaacagtttttgccagtagttgtcatctaatttgtcgctttcacttaaaccgaataagcctgtgtagaattcttcagtaaagacaaattcagaacgcccttccacttgtggtaagtagccccaaatttcatcggcggtgaaggataaaatcggtgccatccaatgtactaatgcttcagagatatgccacaacgcagtttgacagctacggcgtgcaaggctgtctgctttggtggtgtattgacggtctttgataatatctaaatagaacgatcccatttcgattgaacagaaacgcattaaacgctgaacaacggtgtggaattgataattatcataggcttctttaatgtcgttttgcgcatctaatgcacagcttaccgcccaacgatctaatgcgatcatttcttccggtttaaccaaatcacgttttggatcgaagccatttaagttcgctaataagaagcgagcagtattacgaatacggcgataagtgtcgcctgcactgtttaaaatgttgtgcgaaacggcaatttcacctgtgtagtccgtagaagcaacccataaacgtaaaatatctgccccatttttgttccatacttcacttggcacaatcacgttaccgagtgattttgacattttgcgacctttttcatcaacggtaaaaccgtgtgtaagtacttgattataaggggctttattatcggttgcggtagaaagcatcaatgatgacataaaccaaccacggtgttggtctgaaccttcaaggtacatatccgcagaattgccattaaactctggacgttgttgtaccacagacgcataagtcgatcccgagtcgaaccatacatcaagggtatcaggtactttacgatagattttcgcatcttcttcgcctaacacatctttcggatctaaatcccaccatgcttgaatgcctgcttgttcgacacgttttgccacttcttcgagaatttctaaggtgcgtgggtgcaactgttctgtttcattatgtacaaacattgtcatcggcacgccccaagtacgctgacgagagatacaccagtcaggacggttcgccaccattgtatcaatacgcgcttcaccccaacttgggatccaacgaacacgtttaatttcgcctaatgcctgtttgcgtaaaccttgcgtttccataccgataaaccattgcggtgtcgcacggaaaataatcggggttttgtgacgccagcagtgcggatagctgtgtttgatacgctctaatttgagcaacgcccctgtttcttttagtttttcaaggactaaatcattactttcaaacacgcctttacctgcaaagaatggagtagttgaaataaatttgccatcatttgccactaatccagccatttctaatttatatttttgacccacaatatagtcgtccaaaccgtgatctggtgcggtgtgaactaaaccagtaccgccatctgtggtaacgtgatcgcctaaaataaacagcacgctaaaatcgtagaatgggtgattgaaacgcattaactctaagtcacagcctttcgctgaacctaacacttcaacttgctcaacgcccgttgctttttgtacggcttccactaattctgtcgcaagaataacacgctcatcgccaaactgtacgagctgatattctaattccgaatttaacgcaatcgcacggtttgacggcaatgtccaaggggttgtagtccaaatcacagcagaaatctgaccgcttcctttgccctgagcattaaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgagcattaaatttcgcttccacagcaacaggatctaccgctgaaaaacgtacatagattgatggtgatactttatcttcatattccacttcagcttcagcaagggaagatccacagtctaaacaccagtgaactggttttgaacctttgtataagtgaccatttgcaatcactttacctaatgtacggataatatgtgcttccgtatcaaaattcattgtgagataaggattatcccaatcgcctaaaatacctaaacgcataaaatctgctttttgaccatccacttgctcttttgcatattcacggcatttttgacggaattcagcggttgaaatattttcgttcggtttacccaccaaaccttctacttttaactcaatcggcaaaccgtggcagtcccaacctggtacataaggtgtatcaaagcccattgcagttttagatttgttaataatatctttaagaatatggtttacagcgtgtcctaagtgaatattcccattcgcatacggagggccatcgtgcagaataaaggatcttttcccttttgatgcttcacgaattttttgatagagctttttgtcgtgccaattttgtaacatcgcaggttcacgcttagcgagatccccacgcatcggaaagcctgtttcaggcagatttaatgtgtttttgtaatcagtcattttgttgttccaattaataaaattaaaagtctttatgaaaaataagtaagcggtagaaattacccactattttgcaaaatagatcgtactatttggtttacctcttgatgatcttttatttgataaaggtaaatatttttatcctgttttaactgctcaaggcattgttgataatttactgccattcgttcaatcacttctcgctcaacaattcgagggagagtnnnnnnnnnnnnnnnnnnnnnnnnnnnnnnnnnnnnnnnnnnnnnnnnnnnnnnnnnnnnnnnnnnnggtaatgcaagaacataaatttgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgatgagcaaaattgcccgtttttttatgnnnnnnnnnnnnnnnnnnnnnnnnnnnnnnnnnnnnnnntttagggtgaatacgtctataatcatctgcttgaataggaaaataatttaannnnnnnnnnnnnnnnnnnnnnnnaatacaagtcgattttccacttccactcacaccagccacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctgtctgtaaagcgtctgtcatcaccatatcagcaaaagtatccgcacaaatttcgtggaaaacatcactaaaaggcacataatcttgctctaagctggctaaaatttgggcttttctttcttctgttaatctcattttatacctcttgaaagaataatctcaccgcttgtacatctttctcaatttgcaattttaactcatcaaaactcgcaaacttaatttctgaacgaactttctttaaaaaacggacttcaatcgcttgcccataaatagaattatcaaaatcaaacaaatgtacttccaataacggctttgtcccatttatcgttgggcgattacccacattcgcaatactattaaaaatccctgctgatgttttgactttgactgcataaacaccctgaatagccgttactaaacgatttagcatcagatttgccgtcggaaaaccaatggttcgacctaacttattaccgtgagcaacacgaccacaaattgcatagggttttcccaacattttttctgctaactgcaaattatcattatgtaacgcatcacgaataagtgaactactaatccgctgttgctctaaacaatggctgtgcgaattttctacgtcaaacccaaattgctttcctgcctgttgcaaactatcaaaagtccccgaccgcttgtagccaaactggaaatcgtcaccgacacttaaatacttcacattcaacttatcgactaataaatgttgaataaattgctctggttgtaattgagcgaactgagcattaaaacgcacacaaagcaaataatcaaaaccgatttcttgtaaggcgtgaattttatcgcgtaaacgcatcaaacgtgcaggagcggtcagtttatcttgttttttggcaaaaaactcacgaggctgaggctcaaaaatcatcaccactgacggcaaacacaaggcatttgctttctctagcaaacgcttcaaaatttgctgatgtcctaaatgaacaccatcaaaattgccaatggttagcacacagcccttagaaaaatcagcacagtgagctaaattatgcacgcctcgaattaattgcatcggataaaaatagattacgttttcaaacaaaaattatgcccgattatacgaggaatggggggaaatgaaaagaaaagcataaagatattttggcgatctttctagcttatcttggtataattactgtacgcaaacgtttgcttaatgttatacttatgaataagtttttttatttaagaggattgctatgacagttacacaacttagttataaagacgctggtgtcgatattcacgcaggtaatgaattagttgaacgtattaaaggcgatgtaaaacgtactcgtcgtcctgaagtaattggtgggttagggggctttggggctttatgtgccttgcctaccaaatataaagagccgattttagtgtctggcactgatggtgtgggtacaaaactacgtttagccattgatctaaataaacacgacactataggtatcgacttagtcgcaatgtgtgtgaatgatttagtcgtgcaatgctgaaccattgttcttccttgattactatgcgacaggtaaattagatgttgatgtagcaagctctgtcattaaaggcattgccaatgggtgtgaacaatccggttgtgcattagttggtggtgaaactgcagaaatgccagggatgtatcacgaaggcgattacgacttagcaggcttctgcgtaggtgttgttgaaaaatcagaaattattgatggctcaaaagttcaagttggcgatacgctgattgcattaggttcaagtggtccacattcaaatggttactccttgatccgtaaagtgctagaagtgagcggtgcgaaaccaacggatttactcgaaggtaaaccattgagtgagcatttccttgcaccaactaaaatctatgtaaaatcggtgttagagttaatcaaacaagcagaggttcacgctatcgcacacttaacaggtggtggtttctgggaaaatatccctcgtgtattaccagccgatgtaaaagctgtgattaatgaagcaagctgggaatggttgccatcatttaaatggttacaggaaaaaggcaacatcagccgttatgaaatgtatcgcacctttaactgcggtgtaggtatggtgattgctctacctgaaaaagatgtcgaaacggcattaacagtcttaacagaagctggcgaaaatgcttgggtgatcggtaagattgaagcattaggtagtggtacagagctggttgaaatcttgtaatttctcccaccttattcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctgagcgttagcgaaggggatgggggctgagggataaaatctgtgaacaaaaaaagcggatagaagtgtaaaaaagtttacacaactgtccgcttttattttgagattgacatgaggttgtcatgtcaatctttttttgggggattagatgactaagatgccctcttgaatccagactgcatgtttattgtcattattcatggtataaacataatatttgataccattttctgtgactgaacttacagacttattccagcttgccccagatagtccaccagatgcgtctcccaatttgcttgaactaacattagtatccgtcaaccaatcattattgttgttacccaagtcaactttgactttgttgccgttattcacattcaatcccttgtagattttcactgggccttctaagcctgagtttttcaaatctccatatctaatgccgataactgcgccattatccattaactctatgcgctcgaagcctttcactttgtctgtggttgctcttacgcctcccgctatgcggtataagtcaatgcctgtgcccccgtcaatcaacgagcctgcacctataccttttgagtcttggcggaaggtgtcgttgcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggtgtcgttgccttgttggaagttgaagtcgagcttgtagtttttacctgattggtcgttgatgatacctagactttcatgcacgtagacagtatcattgctgttaccccaagtatattttgcacctgcgccatcttttgatacagaagttggcttgctgttgccgtattttccttcttgtacctgttggagaccccatgttgggtcgttaccccagtcttggtagacgtctgaccatctgtcttcccaccaccataatactttcactcggctataacccacacgtcctgtcggtgttccattaccatttcctacgacatttgtgtattccactttgtctgtcgtggtggtgacgtccgcactttgggtgattctgtcttcgttgttatacgattctatcttcacttggcttctgtctttcactgcgtctggtgatagggtgactttgccgtcagtttgcgacaattgaacaccgtttggagcttgagtattgttgctaccatccacctgtttcagtttccagcttccgttctctttttcatatacaagcgttttggttttgttttgctcatccgtgcaagtcaacttgaacttgttggtgttctccttcggtgtcactattgcgccgccttggttagtaccgtcaatctctgctgttggtttcgctggttgtggttcctgagccgcttgagctgttgcatttttacgtgcaataccttggctatcaagtgctgttattgtgacgttggttttgtcttttactgcacttggggcaaaggttacttcgccagtttgggcattcagtttaattgggccattaccgccgttagtatctacactaataccattcatttgcggatttttagttggatccaatttccattgactattctcatacttgaaccaaatcgttctgtttgtaccatcaggttgttgatagtccacttggaaggctttggtttttggctctccattagaaccttctctcggtttaacgataacgccaccttgagcagagttgtcaactgttgcttttagttcgtctagctcttctactttcggtgcaggtgtcggtgctggggtcgttgtggttgaaccaccactgcttgtgccgctgcttccgctagttgagctagtaccacttccgcctgttgcattggctgctgctggaccagttggaaccgatgctgcattgaatgtgagatctgtaagagtaatacctgaaccagcccaaggtgttccttcttcaccagtatacatctcatccattcgacctttggtagaatctggaatagttgtatatacaatatatgttactttattgttaggtgactgtgccgtcgtcttgaaggatatagtcgcttgcgtcagctttttgtgcaccgttagatagcgttgcagtgtcatcgacaacccatttaccttggtctaggtctttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacttcacaaycattctgtcgttatcaccacccggtttcgctacgatgtcgccggagtttggttggtcgttttgaacgccgttaactgcctctgttctgcccgcagtgattgtcggtacgtctgtgcgaactttgctgtattcaggctcattggctgttgcgyctgtaggtcctttgttcagttctttagtttctgcagcgttttgtttgtactgtggcaacaaatttatccccaacggctaatggagttgctgtagattcgctaatatcaaacttgaacttaccgcttgttaccgttgtttctgcaattggttgtccgttagtttgaccttctttgtrgaggtaaactttggttccatctgcttctgtgcttgttccttcaatgatgactcgctcaggatctttgtctgccgttgytgatgtatcaatcgccttgattgaggtaatcwctggcttatctgatttcacatcaaacggagcatctttcctgctggtttcactttctgcagatgtgcgtcctgctacatcagtcgtggttgcactgacagatgttttatctgctactttgtcttcaggaatcgttacactgactttgccactttgatcagtggttggggtgagtttaagtgaatctttttcatcttgaacccagtttccgccagtataggtgtaagtcaatgtcgtcggtgtacccgctgttccattttcaagttctggggtgtagttgatggtgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgcagaatgcattgttttataagggatatttgataggaaaagaactcatttagttgaaaaagtgaagaaaagggagaaaagctaggtggtgtgattgaattgagtgcatttttatcaagagaagggcatttttagccaatgctatcatatgccctagaaatacctacgaattaaaattgctcgccatatttaggcttttcaatatttgtaaaggttttattttgattctctttaatcatttcagaaattttttgcgcagaatctttaatacccatcgcttcaaaagatgtttttagtaagggtaatgcttgatatgttgcctgagtatcgggatataaacgtagcatttcatctactcgattaacaaccgcaacataagcctttctttccatatagaattcggcgatttttagttcatgttcagcgaggcggtttttcaaataaatcatccagttttgagcatctgaggtgtattggctatttgggtattgaaaggtaattgtttggaaattaccgtacgcatttcgaatgttctctattgctctagaggccctgttaattccgaagaaatcttgtatccagttatcgcctaaacgtgcgtagtttaatcctgcaaggtagtaaacataatccatgcttgagctgtttggatgagttctcgcaaaacgttctgcaacctctaatgctttgtaatattcacctaatttatagttcgcataaatcaaacttaattgaatttgctcatcataagccccttgatttgagcgtagatcaactgcatctaaatagcgaactgcattgttataatcaccatcttgtaaatatgcttgtcctttgtcataaagttcttgagatggaataccttcaaattcatcttttttagaacctgaacaaccaacaacaagaagccctgcaaggactaaagaagcaagagaataaaatttacgcataatgatttacctataaaaagtgtctgcaaactgaaagttaatgtacaatgctattcgacctagcattgttcgtgaaagttcgtacgaaaatgctcatattctacaataagaaaacataatttggaattttatcattaatgactcaacaaataacattacaaactgaagtaacttcagatttattaggtgcaagattagatcaagcgctcgctcaacttttccccgattattctcgttcacgcattaaagtttggatcgaaagtgatctcgtttcggtcaatggcaagattgtgaataaagctcgtgagaaagtattcggcggtgaattaattgaaattcaagcggaaattgaagaagaaatccgttttgaaccgcaagatattccattaaatatcgtttatgaagatgatgatattttagtgattaacaaacctaaagatttagtggttcaccctggggctggcaatccagatggcacggtgttaaatgctttattacaccattatcctcaaattgcagaagtgcctcgagctgggattgtacatcgtttggataaagataccacaggtttgatggtagtagctaaaactgttcctgctcaaactcacctcgtcactgctttgcaaagacgtgaaattactcgtgaatatgaagccgtagcaagcggtattatgacacaaggaggcaaagttgatgaaccaatggctcgccacccaactaagcgtaccgcaatggctgttcacccaatgggaaaacctgcagtaacacattatcgtattatggaacgtttccgtaattacagccgtttacgcttacgcttagaaactgggcgtactcaccaaattcgtgttcatatggcacatattgcccacccattgttaggcgatcaactatatggcggtcgtcctcgtccacccaaaggggcaagcggtgagtttttagaggttttacgcaattttaaacgccaagcattacacgcaacaatgcttcgcttgcatcaccctatcactggtgaactgatggaatggcacgctccattacctgatgattttgttgaattaattgaggcattaaaagcagattatttgttgtataaagatgagttagattattaaatgagaaaaaaatccccaaacctatgtctggggataaaatgacaaaaagtattaaatacttaaaatttaaccaaggaaatatctatgaaaacagtaaggaatctctctatttatattgaatggcggtgagagggggattcgaacccccgatacagtttcccatatacacgctttccaggcgtgctccttcaaccactcggacatctcaccgaatcaataaaaaatgtgcattaaaatgcacatttgaaagacgtgcgaactatactgatttttcatagtctaatcaagtattttcttcaaaaaataaaataaattgtgaattaatgtccgtgtcctaagcaatttgttgatgatggaacttcttcgcctcgagctttccattctgttggggtgtaaagatgtaaggctaaggcgtgaacgccgttggctaattcttctgcaaggcaggcataaatagcttggtggcgagcaacaggacgtttgttttcaaagagttcactaaccattgtcactttaaaatgtgactctgagcctcgtccagagctatggcgatggctctcgttttcaatataaagtgctagtggggtaaattgtgcttttagtttttcgacaatagtatgttcaacagacattttttatccttttggtttggaaatttaggtggaataatactatactttgcattacttttaattgagattatcaaggatcctatatgaaattcaataaaaaaacgtttttagttgcaaccacccttgcaaccgcattattagccggttgtcaatctcagtcaaatacactgacgtttactacgccagcaccgaccgcaatgtttaatacccataatcaaacagcgttagtgaatgtgagtacacaagatctgcgtacatcggctgaagtagcaagctataccagtgctggcaatgttaatcgtttaagtgttgtgccaacggtgacacagttataccaacaagcaatgcaacaaaatctgaacagcaaaggttttactgtagtttctggtgctggaaatgcgaatgtgattgtgaatattcgtcaattttttgctaatgtggaacaaggaaatgttcgctataaagtaaccgctaatgttggtgtagaggttgttgttcaaggtgcgagaggtcattttgcgaaaaactttaatacctcccgttcttatgaaggggcatttggtgcaaataataatgaaattcataaggtgttaggtcaggcgtatagtgagtctattcaggcaatctataacgataatgaaattagtaacgctattcatcaatttaagtaacaatgtagaagcggtaagattgagataatcttttgagattatccgtattatgtagcacttacacaaaaaatagtagggacgccacgcttggcgtccattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctaaatttgcaaacagcttatattcaacggacgctaggcgtagcgtccctactgtatgaaaaagtttgcgtatttgctacctgatactgcctgcttacctttaggaacgaacctacccacatttcaatagcaataatgagaataccaagaatttaccacccagaagcccttgctggcaaaagccactgtatcttgagtgaagatgcctttaaccacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttaaccacgttgggcgtgttttgcgtatgggcgagggggctgaacttgttttatttgatggctctaaccatatttttaatgcgatcattgataacgtatccaaaaagcagatcagcgtaaaaatccaaaatagccaactggacgatagagagtcgccgttacctatccatttagggcaagtgatttcccgtggagatcgaatggagtttaccattcaaaaatcggttgaattgggggtaactaccattacaccattatggtcagaacgctgtggtgtaaaattagatggcgagcgtcaagataaaaaaatccaacaatggcaaaaaattgcaatatcggcttgtgagcaatgtggacggaacattattcctgaaattcgcccgataatgaagctgaccgattggtgccaagaacaagatggaatgctcaaactaaatcttcaccctcgtgctaaatacagtttaaaatcgttaccgaatgtacccaaagagggcgtacgtttgttgattggttcggaaggtgggctttcccctgaagagattgcaatgacagaagcggagaattttacggaagttttacttggaaaacgtattttacgcacagaaacggcttcacttgccacgatcacggcattacaaatgctttatggagatctcagctaaatgatgaatttacaaggacaatttttgattgccacgcttgatatgaatgatgactattttgatcgtgcggtgatctacatttgtgaacataatgaacacggggcaatgggcataatgatcaactcaccgacagatctgtccgtgatggaattgctcgccaaaatggattttttaatggcaaatgaacgcaattacaccaaagatcagctggttctcagtggtggacctgtggggcaagagcgtggttttattttgcataccgcaaccgatcagctctttttacatagctatccaaccgctgatgatttaatgcttaccacatcgggagatattttagacacctttggacgacaagatgcccccgctgattttatcgtctgcttaggctgttgcacttggaaggctgatcagcttgagcaagaaattgcatgcaattactgggtaactgcccctgcgtcccataaaattctttttgaaacaggttatttagatcgttggagcgaagcgaatgcattactgggtatcgaaggcattttagctaaagcagggagagcctaatgagccaaactgtgcttgcctttgattttggaacaaacagtattggctgtgccgttggacaaagtattacgggcacggcacagggtttgtctgcgtttaaagctcaagatggcataccgaattgggagcagattggcaaagtgattgcacaatggcaaccagatctcttagttgtcggcttaccgcttaatatggacggtacggagcaaccgctcacgcaaagagccaaaaagtttgccaagcgcctaaacggacgctttaatttgcccgttgaattacaagatgaacgcttaaccaccgtagaagcaaaatcagaaatttttgccagaggcggttttaaagctctcaaaaaaggcaaagtcgatgcgatttccgcttgtttaattttagaaagttggtttgaacagcaatcataaaatatagcagttttgaatctataaactttgatacaacttaaacgcttgcccatcagacatactcgcaaggtagtcacaaatcactcttggacgttgctgttcatctgcttgtatccaacgttccgccacagatttaggcagtaagcgggttggatcgcaacttagcatatcaaacagatccattaaaatttgctgacctttatattccacccgttgcgttttgacatcacaaataacatattgatagacaaagtttttaagtacttctaacaccgcttgtgcttccgttggtaatatcgcattaaaacgcagtaatggctcttcaaactctgctgtttctgtccattttacatttgtcacaaaataattgactagcgctccaataacatctttgcgttcgtagcggtgaattgagaacaattttttgctgatgtcaggtaacattttttgaatccaagctgatttacattgagagaaggcttgttccgcattttgccacgattgcggcgtgaccattccgccaacaatcgcatcttctaagtcgtgaaccccataagcaatatcatcagccaattccataatactgcaatctaaggatttataacgggttttgtggggaagcagtggatcttggcttatttcaatttgttgaaataacgctctatctgcgacagaaagcggttcaagcacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaaaaaagtgagcgtctgcacggaaaattcccttacttgtttttagatcgtgtaagttgatataacggctatttggaatggcttttggagtttgtggctgagttaaatcaataaaggtaggatatttgatgatacctaacaaggtgcgacgcgtcaggttcattcctgcatttttggtataaggctcaagctgagtgacaatgcgaaaggactgagcatttccttcaaaaccaccaaaatcctgcattttataattcaatgccatttcaccgccgtgtccaaaaggggggtgtccgatgtcgtgggcaaagcatagggattccgtcaaactacgagaaggtaataaagcggtgagatcttcattgaattttgcaaatgttggatcggaacagaccgcttgaaagccttgcctatcttccaccaattttgctcttaagctactgccaatttgggcaacctctagagagtgggttaagcgtgtgcgataaaaatcatcttcgccaactgcgtgaatttgtgttttggcttgtaaacaacgaaaagcttccgaatgtaaaatgcgtcctcgatctcgttggaaaggggaacggtgatcttgttcgcgttgtttgtctgcaataaaacgtgatgtccaagctgaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttattttcctccttagtcacagtttaggctataatagctgataattctttttgtttaaaccttattcaaatggcacttttttattctgataattccgcaaaaaaatccgcaaaaccgaccgctttacagacctttcatatccaatctttagactatcaaggattcggcgtggcgaaagtcaatggcaaaacgtggtttattgaaaatgcgttaccgaatgaaaaggtggaagccaagattattgaagataaacgccaatatggacgagcgacagcggtacgatttctacaaaaatctgcagatcgccaaacgccattttgttcaatctatagccaatgcggtggctgtcaaatgcaacatattccactggctttacagcgagaaacgaagcaacagacgctttttaaccgtttacaaaaacttcaagcagagcctatcagatttgagccaatgcttgtcgggcaaggcacaaactaccgccgtagagcaaagctgagtatggcggttcaaaaaaatacgttggtggtcggctttcgccaagcgaatacgcaagagattatccctctaaatcattgcgatattcttgagcctgaacttaatacgcttttacccaaattacagcaactttttgccagttggaaaaataaaaaacagttagggcatattgaactggttcaggcggataatggggtggcattgctgttacgccatatcggcgaacttcattcacaagacagcgaaaaattacaacgctttgcggagcaagaaaatctcttgctgtttgtgatgacagataaagatcagattagtcagtggcgtggtgaagttccttattatcaaatcaacggcttaacgcttcacttttcgatccgtgattttattcaaatcaaccgagaaatgaacaagcaaatggtgaacaaagcgatagtgtggctcgatctgcaaccgacggatcgagtgcttgatctcttctgcggaatggggaattttaccttgcctatcgcaccgtttgttgaagaagtggttggtatagaaggggttgagccgatggttgcacaagccaaacagaatgctcaaacaaatcagattaacaatgcgaagttctaccaaacggatctagataaaccttttgtagagcaaccttgggcaaaagcacattttaataaagcattgctagatcctgctcgcaatggggcttactttgccttagatcatctttgcgaattacaaccagagcggatcgtgtatgtttcttgcaatccagcaactttagtcagagatgccgaaaaactgattgcaaaaggatatcgtttaagccaatccgcaatgattgatatgtttccccatacggcacatttggagtcgatttcgttgtttgaaagaagaacaaagaataggttctctaattaatgaattcctatgtagactaaagttataatgttcttacttttgtcgcagccaaagtaaactatttttcatatatggttaaaatagaggagatgttagatacaaatctagaacatttttttaacaaaaaagcgatttttaataaaaaaaagtattgcatttcataaaaaaacttatatattccattttgtcgggtaaaaaaataacccctcaaacacaacaaaaaacaactatcacttggagtgaagcaatgaaaaaattaacacaactctctttattagcattggcagtggcttctgggtctgcaatggctgcaccaaaaacctttgtttattgcttggaagcatcaccttcttattttagcccagcattaggtactgatggtgcaacactagatgcaagtggccgtgccatttttaataaattaaccgattttaaagaaggtgaaaccaccgttgttccatctttagcggaaaaatgggacgtttctgcggacggtaaaacttacacattccacttacgtaaaggtgtgaaattccacactactaaagatttcaaaccaagccgtgattttaatgcagatgatgtacttttctcatttaatcgtcaattagatgcaaatcatccatatcacaaagtttcgggcggtaactacgagtatttcgttggtatggatatgcaaaatatcattgataaagtggaaaaagttgatgactacacggttaaaattagcttaaaagtgcctaattcaccgttcttagcaaaccttgcgatggactttgcttctatctactcggcagagtatgctgataagatgttagcagcaaaaacaccagaaaaattagatagcaatccagttggtacaggtccgttccaatttgtggattaccaaaaagactcaaccgttcgttacaaagcctttgatgattactgggcaggtaaagcgaaaattgatcgcttagtgttctctattacgccagatgcatctgtacgtttagcgaaattacaaaaaggcgaatgtcacgcaatgccttatccaaaccctgcagatattgcaaaattaaaatcagatccaaacattgaagtattagaaaaaccagggttaaacgtgggctatttagcgttaaatatgactaaagcgccgttggataaccaaaaagtacgccaagcattgaaccacgcaattaacaaagaagcgattattgaatcggtgtatcaaggttttgcaaaagtagccaaaaacccaataccaccaacaatgtggagctataatgacgacgtgaaagattatgactataatcctgaaaaagcgaaagcattgttaaaagaagcaggctttgaaaatggctttgaaacagaattatgggcaatgccagtttctcgtccatataacccgaatgcacgtcgtatggcggaaattattcaagatgattggaaaaaagttggcgtaaatgcgaaaatcgtcagctacgaatggggtgagtacttaaaacgtttacgcaacggcgaagcctctacttcaatgatcggttggacgggcgataatggtgaccctgacaacttcttaaatacgctattaagctgttctgcattagaagctggctctaactatgcgaaattctgttataaaccgttcaatgacttagtcacccaagcggctcaagaaacagatcaagcaaaacgtactgagctttataaacaagctcaagtgattttcaaagaacaagcaccgtgggtcactatcgcccactcaacaacgtacttcccagtacgcaaagaagtgaaaggttatgtggttagcccgttcggtttacataacttctaccaagtagatttagcgaaataaggcaacattgtagggtgggtcttgacccaccttttagtttagttatggtgggtcaagacccaccctacaaattgaaaaacgctgagatatttaatgtttcaatttattcttaaacgtcttttaatggttatcccaacctttattgcgataaccttgattacctttgctcttgtgcatttaatccctggcgatccgattgagatccgaatgggtgaacgtggtttaacgcccgaagttcacgcacagatgatggcacagcttggtttagatcttccgttacacgaacagtattttaactatatcaagggtgtgtttcagggggatttaggtaattcgtttcgtaataacgaacctgtgctgaaagaattttttacccttttcccagcaacagtagagttagcattttttgctctgttgtggtcgttggttgctggtattttatttggcgtgattgcggcggtgaagaaagaatcttggctttcccacgctatttcgtcgatctctttaacaggttattcaatgccaatcttctggtggggcttaattttaattctttatttttcaacgccattgggcttgcctgcctcagggcgtttacctgcagaatactggatcgaagctgaaacaggctttatgttgattgatacttggaattctgacgaaccaggtgcgtttgtagcagcgattaaatcgttgattttacctgcgattgttcttggtactattccattagccattattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcgatgttggaagtgttgggtgaagattatatccgcaccgccaaagcgaaagggttaaacacaacgcgtattgtgattatccacgccttgcgtaatgcgttaattcctgtggtaacggtggttggtttaattgtgggacaactattatcaggggcagttttaaccgaaaacattttctcttggccagggatcgggaaatggattattgatgcgatcaattcgcgtgactaccctgtgctacaaggttcagtgttgattattgctaccttgattattttagtgaatttaaccgtagatttgatttacggcgtggttaatcctcggattagacatacttaaaaaatagatttatttgttggagtaataaatgtcttctcaagtagaaacaacctcaccagccccactaacacctttacaagagttttggctctattttcgccaaaataaaggggcggtggttggtttaacttttattgtgattgttgggcttgcctgcatttttgcagaatttgttgcccctttcgatccgattacacaaaaccgcagtgcattgttattgccacctgcgtggtttgaaggcggtaattctgcctatttactcggcacggacgacatcgggcgtgatattctttctcgtattatttatggggcaagattatcaatctttatcggtctgttgatcgtcgtgatgtcctgtattctaggggtgattttaggtttgttagcgggttattacggcggcactattgatatcgtgattatgcgttttgtcgatattatgctcgcaattccaagcctattattaaccatcggtgtcgtgactattcttggaccttcgctactgaatgcggcgattgcaattgctgtggtgtctattccaagctatgtgcgtttaacccgtgcttctgtgttaagtgaaaaaaatcgtgattatgtgaccgcttcccgtgtggctggggctggcgtatggcgtttgatgtttattgtaattttgccaaattgtttagcaccgctgattgttcagatgacaatggggatctctaatgcgattttagagcttgcggcacttggcttcttggggatcggtgcacaaccaccgacaccggaactcggcacaatgcttgccgaatctcgtggctttatgcaatcggcaaattggttggtgacaatccctggtttagcgattttatctctcgtgcttgcctttaacttaatgggtgacggcttgcgtgatgcacttgatccaaaattaaaacagtaaggggaacgaaatggcattattaaaagtagatgaactttcggttcactttggcgataaaaaagccccgtttagagcggtggatcgagtaagttatgaagtcaatgaaggcgaagtgttaggcattgtgggcgagtcaggttccggtaaatcggttagttctcttgcgattatggggcttattgatttccctggacgtgtaatggcaaattcgttacgtttcaacggacataatctgcttgatttaaaaccaaaagagaagcagaaaattgtcggtgctgatgtagcgatgattttccaagatgcaatgacaagcctcaacccaagttacaccgtgggttatcaaattatggaagccttgaaagttcaccaaggcggttcaaaagcgtggcgaaaagagcgtgcgattgaattattaacgatggtcggtattcctgacccgacatctcgtttagaggtctatccgcaccaactttcaggcggtatgagccaacgtgtaatgatcgcaatggcgattgcttgcaatccgaaattattgattgctgatgagccgacaacggcgttagatgtaaccattcaagcacaaattattgatttattgcttgagttgcaacgcaaagaaaatatggcattgattttgattactcacgatttggctttagttgccgagtcggctcaccgtattatcgtgatgtatgcagggcaagtggtggaagaaggcaaatctgaacagattttcaaatcaccgcttcacccttatacccaagcgttattaaaagcgttgcctgagtttgccgaaggtaaatctcgcttgcaatcactaccgggtgtcgtaccgggtaaatatgaccatccgcaaggttgcttgctcaacccacgctgtccgtatgcaacggatttatgccgacaaaaagagccggaactacgcacagtaaatggcagacaggtgaaatgccatacgccgttgaatgaaagtggattgccacaaccaatttagtaagatagataaatatgcaaaacaatacccaaaacccaccgcttctcaatgcggcggatctcaaaaaatactaccctgtaaaaaagggaatgtttagcaagccgaaactagtaaaagcggtggacggcgtttcttttacccttgaacgtggcaaaacccttgctgtggtgggcgaatcgggctgtggtaaatcaaccttagggcgtatgctgacaatgatcgagccaccaacagaaggggaattgttctacaacggacaaaatttcttagtcagcgataaggaaacagaaaaattacgtcgtaagaaaatccagatcgttttccaaaacccttatgcgtcgcttaatccacgtaaaaaagtcggggcaattttagaagaacccctgcttattaataccgaattgtctgcacaagagcgtaaggcacaagtgttagaaatgatggcaaaagtggggctaaaacctgagttttgcgaccgctatccgcatatgttctcaggcggacaacgccaacgtattgcaatagcccgaggtttaatgctgaaacctgatattgtggtggcagatgaacctgtgtcagcccttgacgtatccgttcgtgcacaggtattaaacttgatgatggatttacaagaagagcttgggttgtcttatgtgtttatctctcacgatttatcggtggtagaacatattgctgacgaagtgatggtaatgtatttaggacgttgtgtagaacaaggcaacaccaaagagatcttcggtaacccacgccacccttacacccaagccttgctatcagccacaccacgtttggaagcggagcatcgccgagagcggattaaactcaccggcgaattaccaagtccgcttaatccaccgaaaggctgtgctttccacgcccgttgccgtttggcgacagagcgttgtaagcaagaacgtccagagctaaaaacctatgaaaacggcacgaagatagcttgttttatggtggagtaagaattttatatttgttgtatgctttattgccttactctatagtaaggcaatttaatttctaaatctaaaccttcctcgactatatctcgttttcatcaacgccagaatttgctctttttcgcttgataccgcttggctactctgtttagccaccgtaagcgaatgttgaatagagtgagcgtgagtaatggcaatcgccaaagcatccgcagcatcagcttggggtttggcggaaagttgcaaaatacgtgtaaccatatcttgcacctgcactttatctgccgaaccaatccccacaaccgtttgttttactaaacgtgcggcatattcaaagacaggcaaatcgtgattaaccgcagcaacaatcgccgttccccttgcttgccctaatttcaacgctgaatccgcattttttgccataaatacttgctcaatggcaaacatatcgggttgaaactgggtgataatttctgtcacccctgcgtaaatacgttttaatcgagttggaagatcttcaacagaagtacgaattgctccgctaccgagatattctaaatgccgccctgtttgacgaatcacgccatagcctgttacgcgagagcctgggtcaatacctaaaataattgccattttatgtccaaaaagaaagtggatttgttattcacaaacccactttatagtcaatcttaattagataatcaacttattttgcaacagtgcagtttttcgcaagaatttgattgtttgcggtaaacattacgggcactgttgtttcagctgttttcgcattaaagcccatatctagactccatacctttttaccagacacaaatttcacaccgtcttgataggttgtatctactttcagatttttacctaccacttttttgttaatggttacagttgcagttgatggctcgccattgttgaaagtataaaccgctaaaacaggttggtttgttttgccatttacgctacaaatgtaagcaatagtttttgagcctgttaccatatcttttgcagcagtnnnnnnnnnnnnnnnnnnnctacccgcattacccacagcatttgctgttgaagatgcaacatcagaaactgttgaacaagctgcaagtaccgcagctgctgcaaatgttggaagtaatttaactaatttcattgtttttcctttgtgttgattaaaaagatcactcctttagaaaaggaaaaaacaggaaagttcaaaaaaataatctcaagctaaatacttgagattactttttattcatttttaattaaagcaatgcagccacttcatcgctgatttcgccattgtgataaacgttttgcacatcatcacaatcttcaaggcggttaattaaatccaataattttggtgcggtttctgcatcaagttgaacagtggttgatgggatcatcgtcacttctgcattttcaactttgaaacctgccgcttcaatgccatcacggacagaacctaagtcttcccaagcagtatagatctcaaatgaaccatcttcttgtggctgaatatcatcagcacccgcttcaatcgccgcttcagttaatgcgtcttcgtctgcacttgcgattaaaattaaaccttttttgctaaataaataacccaccgaaccttcagtccctaagttaccaccacatttagtaaaacttggacgtacttgtgagattgtgcggtttgcattatcacttaaacactcaaccattaccgctgtaccacctggaccataaccttcatacactttggtttccatattggtatcatcgccaccgccaacaccacggtcgatagcacgattgatggtatcacgtgtcatattattcgataacgctttatccacagctgcacgcaaacgtgggttagagctggtatcgccaccacctaattttgccgctgtcactaattcacgaattaatttagtaaaaattttaccacgttgagcatcttgtgctgctttgcggtgtttaatgttagcccacttactatgacctgccattctcttgtttccttctttattatgttttgaaaaaatccccctctttagcaaagaggggttaggagagatttggcagaactgcttctcgctcataagagaatttgacattgctatcaaatctcccccagcccctcttttctaaagaggggagttgcttgttaaatattttgcaatcgcttcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcattagtactcgctgagtttttttggcataaatcaccacgagaacagaatagggatttttgtagttcatttttatgtactatacaagagtttttacatcggatatgtgcgctcgacctttatcgtttatggtttttcagcatgtgctagaacattgtaaaatttcaaagagtaaataacaagattagatactgaaatgaattgattagtcaaatcgtgcgatttttttctgagaaatgaatgcttaaatttatgctaaagcggtgagattttcataagaatacgatttcaaatttcccttatatcaattttttttgttatcctaacgacaatgtaattgaatagacttatcttatatgaaatttattagaaaaaatgctgtatcgtgcatcatgttaagtagtttttatctataagcacttatgcaaatcccttgaaaaccatcttacagcagaatttatcaaatgcacctgaagtgaaagaagcacttgcaaacgttgaagttgctcagaatcgtgttgaacaaagtaaatctcaacattttcctattgttagcgtaacaggttcaaaaactttaagacagtatcataagtatgaagataattatggttcaaccaaaatcatccctggtattcaggctgaaatgaatatctttgcttttggcgctattgagaaagatattgaacgcagttataaagagaaggagtactatgagcatacctataccgctactcaagaggaaatagcgtatactattggacaactttatttaacggcactgaatatgaaggaagccatttctgtaatggaaaagagcttatttcgccaccagaaaattttacaggatttggatattatcatggagaatgatgaaggacgagaatccgaatttgttcaagctgagacacgtatgttgatggttcaacaagaaattaataattatcgacaaaaattattagctactttgaatacactatcaaaatatacaaggactaaagttgttgaagaacaattaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaattaagtgatcctttccttcagttgaaggaagaacagctttctccttctttattttttataaataagaaggagaatgtttattttgtcacatatctatgattgatttcttctttctgtattggttaatatggttatgttgacatctactctctactcatatttagttcttgtgggagtgaagctagtaattatatagataataacttattcattaatatgtgtcttctttatataatattgtcgataggtagaattaaggacaatgcaaatatattacccaaattatcaaggatctgaccgcttgttagatctcacctccccgaaaattatggggattttgaattttacccctgattcgttctccgattcgggcaaattttttacccttgataaagccctgtttcaagtggagaaaatgctcaatgacggggcggatattattgatattggtggtgagtccacccgttcgaatgcagaaattgttacccttgagcaagagttggaacgggttgtgccgttggttgaagcggttcgcaagcggtttgattgtttgatttcggtagatagctcaaaggcggaagtatttcgtcaatccgcacaagttggagcggatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcaggcattcccaaagagcatattattttagatgtcggctttggttttggtaaaacggtacaacataattatcaactgctaaaacatctaaatgcctttgtagcttcgggctatcctgtgttagctgggctttcccgtaagtcgatgatcggcaatgtaatcaataaaccagtcgatcaacgtgtagcaggcagtgtcgcaggggcattgctcgcagtgcaaaatggagcgaagatcgtgcgagttcacgatgtagcagaaaccgctgacgccttgaaagtgtggcaagcgatgaatgaatgtgaataaaaaggaagataaaatgacaaaaatctacggcattaaaaactgtgataccgtgaaaaaagcgatcaaatggcttgcggataacgacttaaacccacaacttcacgactaccgtgtcgatggcttagatcctgtttggctggctgaaatggcagagaaatttggttgggaaaacttagtcaataaacgtagcaccacttggcgtgggcttgatgatgaaatcaaaaataatctcaccaaagagctggcactaaaggtgttaaacgaacagccaaccttaattaaacgccctattgtgattgctgatgatgctgcgttgattggttttgatgagaaagagtatcaaaaggtatttatgaaatgatacccaacatattaattatgttgagtaaaaggggcaattttaagggctctctgtttattcaaaggtattggataggatttggatcatgagttatattgtagctcttactggcggtataggaagtggtaagtcaactattgctaatctttttgctgcacttggtgtgccagtgattgatgcagatattattgctcgaaatatcgttgagaaaggcagtcctttactcgctcaaatagtagctcattttggcaaacaaattttgtttgaaaatggtgagcttaatcgtacagcattacgacagcggattttccagacagaatatgagaggctgtggttaaatcagttacttcatccagctattcacacagaaatgttaaagcagttgaatgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatgaaagccaatctccctatgtgctttgggttgttccattattgattgaaaaccagctaatggcattatgtgatcgtattttagttgttgatgtattgcctgaaattcagctagaacgagctatgaagcgagataaaagcaatgttgaaatgataaagagtattatgctatcacaggttgatcgtcaaacacgattaaactatgctaacgacgtgattgaaaataatttaccttttggtgataatgaagtccatctgactcatcaagtggcaaaattgaatgaatattatttgactctaagtaaaacaaaagggaaatagatcatgctcgtcgtattctgtccaaattgtggcaaagaagtggcttgggttttgggcaataaatatagaccattttgcagcgaacgctgccatttagttgatcttggcgaatggctcaatgaagaaaatcaagtccttgaaagtgatattcagtctgcagatgactatgatatggtggtaagtgagggtattttctaatgaaataacaaactaaaccgttcaatgccttgccaagcctcatcgctaaattcttgttttacctgtttttccaattcggcaagggattgaatgagttgatagagtttatggtaagttaaacgttgtactgcagcttgataaaacccacggcggttttgccatactttcaagcggtcaaattcggctcgtaaattaccgctatacagaggttggtgactattgataatcggctgtggtgagcgtgtcatttcaagtaataaaagtagctctttttgtacgatgcgtagcaacaccactggttgtatctcttcattctgcagatgttgaagcactcttaatgctcggttaattttgccttctaataaggcatcaacccattggaatggggtgaattgtgccgattgttcgatcacttcttttactcggtttaatccaatcttttgttcagcaaaacggagttgtaacatctgcaatgcttgttttagtgccagtagattgccttcgtagctataacaaagtaattgaatagcatcaggctcaagctgcaactgcattgttttagctcgatgttgtagccaaataggtagttttgtaatatctggtgtttgacagtttacgactacggcattatttagttgtacaaaccagctctgtttttccattgctttggttagttttggttggtgcagaacaaaaagtaaatccgtgtgagaaaaagccagtagttcagatagctgtttttgctgtgttacagttaggttttcaggcaggttaagaattagaatttggcgattaaaaaaaagcccatttgattgaaccaggtcaaacagcatatcccattgggtatcattggcaatggtaaactcttgtttttcatcaaaatcctgtaaacgagccgtttgtacaatacagtcttttgcttcaccaaccaataagagatcctgcccggtcaataaataaaatggttgtaaacctttattgagggcaggttctaatccttctgggaaaatacgttgcatcatcttatttcgtatttgctaactctttttgtaatcctgcaactttaataagaagctggcgagaggcttgttcatacatttgacgctgaatactttcttgttcttctgattttgctaaagcggcacgagagtcgtcgaagaaagtacgatgaacgctagtttcaatcggatatgcccctttatttgggattgttaccgttgctttcaccgttaaactgaggattttttcagcttcacgcgcttgtttaaagactgacgcaacacgagagctactttctgttgcgtttaagcgtaaactcgcaacatcagcggatttcggcacgatttgaatgttactgagtaacatttggttacgcaaaatgcgtgacatatcgctgtactgatccgcactttcaaaactcaaggtacgcaactcttctgggaagagttcattatttttaaaatgccaaccgcaagcggttaaaaatagcacacaaatgagagagagtttttttaacataccatattcctattttgtagggtgggttttgacccagcatatacgatgtagactagatggtgagttaaaacccaccctactattatgctttcaccgcaaaactcaacatcttaaacggtacatagatctctttcacgatttctacgccttcaagatatttcgccacattttcatcggctttcgcaatcgccttgacttcaccttccgttgcggttgcagatacagtaattttaccacgcactttaccatttacttgcaccacaaccagtttttcatcttctaccattgctttttcatctgccaccacccaaggtgcaaagtcaattgaaccctcattgcctaaggcttgccatagttcaaagcagatatgcggggtgattgggtagagcatacggatcaccgcatttaatgcttcagccatcacggctttgtcttgatcattaacaagcggtgctttggtgagcttattcatcaattccataattgctgcaattgcggtattaaaggtttgacggcgaccgatgtcatcactcactttcgcaatggttttatgtacgtcacggcgtaaatctttttgctctttgcttaatgccgtaggatctaatgcaacagtggctggcgattgtgcatactcataagccaagttccaaagacgacctaagaaacgtttcgccccttctacgccagactcttgccattctaatgtcatttccgcaggggaagcaaacatcataaatagacgcaccgtatccgcaccatatttttccaccatttcttgtggatcaataccgttgtttttcgatttcgacattttggtcataccgctgtgtaccaacgcacgcccttctttgtcaaaggctttcaaaatacgccctttttcatcacgttcaactgtcacttctgttggcgacacccaaatacgttcattggttgggctggtgtagtaataagcgtccgctaacaccataccttgacagagtaatttttctgtcggttcatcgctagtcacgaaaccggcatcacgcaataatttgtggaagaagcggaagtagagcaagtgcattgttgcgtgttcgataccgccgatatattgatccacaggtagccaataattcgcttcttctttgtctaacataccttgttgatattgtggcgacgcataacgtgcataataccaagaagactccataaaggtgtcgaaggtatctgtttctcttaacgctggctgaccgttataagtggttttcgcccattctggatctgctttgatcgggcttttcacgccgtccatcaccacatcttcaggtaacaccacaggtaaatcttgcattggtacagtcacagtttcgccattttcaagggtaagcattggaattggcgccccccagtaacgttggcgagaaacgccccagtcacgcaagcggtaattgacttgacgtttaccgatccccattccttctaatttatccgcaatacctttgaaagcgccatcaaaatctaacccatcaaattccgcagagttaatcaatttaccgtgttcagtcattgccgctttgctgaaatcccattcagaaccatcaagcggtgcgatcacctgtttaattggtaaattgtatttttgtgcaaattcaaaatcacgctcatcgtgagcaggtactgccattacagccccagtgccgtagtgcatcaacacaaagttagcgacccagacaggaacttcttcgcctgttaaggggtgaatagcaaacaaccctgttgccattccttttttctccattgtggcaatatccgcttccgccactttggtgtttttcgcttcttgaataaaggcagctaatgcaggattgttttctgctgccagggttgctaatgggtgagccgccgccactgccacatagctcacaccaaagaaagtatctggacgagtagtataaacaggcaaggtttgatcagctcctttcactttaaaagtaatttcaaccccttcagaacgaccgatccagttgcgttgcattgttttcacttgatctggccataacggaagacgatctaagtcatttaacaattgctccgcatagtcagtaattttaataaaccattgcggaatttctttttgttccacaggggtatcacaacgccagcaacagccttcgtggacttgctcatttgctaacaccgtttcatcattcggacaccagtttactgtcgatgttttcttatatactaagccttttttgtacaattcagtgaagaaccattgctcccatttataatattcaggacggcaagtggtcacttcacgatcccagtcaaagccaaaacctaaggccttgagctgatttttcatatattcaatattttcataagtccattttgctggtgcagttttattttttaccgctgccccttctgcaggcaagccgaatgcgtcccaacccattggttgtaacacgtttttgccgttcatacgttgataacgggaaaccacatcgccgatcgtatagttacgaacgtgtcccatatgcagacgacctgaagggtatgggaacatagataaacagtaatattttggtttgctttcgtctttaattgctttgaatactttattttcagcccagtactgctgtactttaggctcaatcgcactcggattgtattgttgttgcatcatcttcattcctcaaatttgtcgaaaaattgcggtatagaatagcgtaaaaatggggatttttgaaatgatattaagttcgcggtataaacaaaattaaatagtgaagcaaactccgtagatgtaaattagtcatttgttcgtattttaggctatgtcagcaaagcctaaagccccagcaaaattacctgatcgagaaaatctcagggaaattttggcttacaacattcaaacgttgcgtgtgcagaaaggttggtcacaggaacgattagagaatgagtgtgagttagatagaacttatgtttcagcggttgaacattgccgctggaacgtttcgctttcaaatattgaaaagttagcaactgcactttcttgcccagcttggcagttattgaaatacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaatacccagaaaatagcaatcaaaatactgaaagatatttagatttatgctaaaatgcacccgctttttcgtccgcccgattgttagggcgagtaaagcaacttgcaaaaaattttgaaaaactgaccgcttgcaagcggtcttttgttttgaaaaatttacgaatttcaatgatttacccgtagggatacactgcgtgtgtccgnnnnnnnnnnnnnnnnnnnnnnnnnnnngacacacgcagtgtgtccctacgggaataacataaaccaacaagtaacctttcgtatgggttaccactgtataaggattaacaatgccaattattactttacctgatggctcacaacgccaattcgacaatcccgtttctgtaatggaagtggctcaaagtatcggtgcaggtcttgcgaaagcaacaatcgcagggcgtgtaaacggcgaacgccgtgatgcttctgacattatcagcgaagatgctacccttgaaattattactacaaaagatgaagacggtttagagattatccgtcactcaacggcacacttactgggtcacgcaatcaagcaacttttcccgaatgtgaaaatggcgattggtccgacaatcgacaacggtttctattatgacattgatttagaccgctctttaacgcaggaagatcttgatgcacttgaagcgcgtatgttggaactggcgaaaaccaattacgatgtagtgaaaaaacgtgtgagctggcaggaagcgagagatacctttgaaagccgtggcgagtcgtacaaaatggcgattttggacgaaaatatcagtaaagatgaccgcccagcactttatcatcacgaagaatatattgatatgtgccgtggtccgcacgtgccgaatatgcgtttctgccatcacttcaaattacaaaaagtggcgggtgcatactggcgtggcgacagcaagaataaaatgttgcaacgtatttacggtacggcgtgggcagataaaaaacaacttgccgactatttacaccgtttagaagaagcggcaaaacgtgaccaccgtaaaatcggtaaagcgttagatttatatcatatgcaagaagaagcaccaggtatggtgttctggcacaatgacggctggacgattttccgtgagcttgaaaccttcgtgcgtaccaaattaaaacagtacgattaccaagaagtgaaaggtccatttatgatggatcgtgtgttatgggaaaaaacaggtcactggcaaaactacggtgatttaatgttcaccactcaatcggaaaaccgtgaatatgcgatcaaaccgatgaactgcccaggtcacattcagatcttcaatcaaggtttaaaatcataccgtgatttaccgttgcgtatggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtatggcggaatttggttcttgccaccgtaacgaaccgtctggttcattacacggtttaatgcgtgtgcgtggctttacccaagatgatgcccatattttctgtatgccagagcaagtagaaagcgaagtcacatcgtgcattaaaatggtgtatgacatttacagcactttcggttttgaaaatattcaagtgaaactctcaactcgccctgcaaacagtatcggtacagatgaaatgtggaacaaagcggaagcagacttagcagccgcattaaccgctaacggtttatcctttgaaattcaagaaggcgaaggtgcgttctacggtccgaaaattgagtttgccttgcgtgactgtttagatcgtgaatggcaatgcggtacgatccagttagacttctttttaccagagcgtttaagtgcatcttatgtggcagaagataacaaccgtaaaacacccgtaatgatccatcgtgcgattttaggctcaatcgagcgtttcatcggcattattaccgaagaatacgcaggtttcttccctgcgtggttagcaccagttcaagcagtcgttatgaacattaccgacagccaagcagaatacgttcaacaagtggtaaaacaactttctgatgctggcttgcgtgtgaaagcagatttacgcaacgaaaaagtgggctttaaagtgcgtgaacacaccttacgccgtgtgccttatatgcttgtttgcggtgataaagaaatcgccgaaggcaaagtgtctgtgcgtactcgcaaaggtgcggatttaggtacttacaaagtagaagagtttgtcgaaatgctcaaaaaacaagtgcgtggacgtgagttgaagttacttggggaagagtagtcagtttagatacactaggaggccaatgtagaggagagtaattctcctctcattactaataggcatagtagacaaaagtattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtactaatgawgaaatcaagaccaaagcggatggttcaacaatcacgatttcgttagaggacaagattaagaaacaactggctsagattgccrmtaaaatgtcatcctttaagattaaannnnataacaatgaagctacaattaaggatggaratacratccagtttactgctggggacaatataaagattacccacaataataaaaayctaamttttgcmgtcacttcaggtagctttaatactacaacaaatggcagattatcacaacaaaccgcagggctwgcwaccgttratgmtgtagtatcggcagtgaataatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtctactatgcctactaatatagagtgctcacaaattcaccacaaatttcccaaccccaagatcatcttctttgcgagtacgattaatcacactttgagcggattcaataacacgtaaacccatctgatcttcggttctcaccacttcaccacgcaatgagttggtataaacatcagtaattttaacatccacaaatttgccgatcatattaggtgtaccttggaaattgacaatacggttgctttcagtgcgtccggttaattccataatgtctttcttagatgggccttcaactaaaatacgttgttccgtacctaacattgcacggctaaattgcattgcttggttgttgatacgttgttgtaagcggtataaacgctcttttttctcatcttccgtcacatcatcaggcagatccgcggctggcgtacctggacgagcagaatagataaagctgaagctcatatcgaaattgacctgctcaatgattttcattgtttgttcaaaatcttgagccgtttcacctgggaagccaacaataaagtcagagctgatttgaatatcagggcgagcctcacgcaatttacggataatggctttatactccaacgccgtatggttacgtttcatcattgttaaaacacggtctgaaccactttggataggtaagtgtaagaagctcactagctcaggggtatctttatatacctcaatgatgtcgtctgtaaattcaatagggtggcttgtggtataacgaacacggtcaatgccatcaatcgaagcaactaaacgtagtaattccgcaaaagaacagataccgccgtcaaaggtttcaccacgataagcgttcacattttgaccaagcaaattcacttcacgcacaccttgttcagccagttgagcaatttcaaataacacatcatcgacaggacggctaacttcttcacctcgtgtataaggtacgacacagaatgagcaatacttattgcaaccttccataatggacacaaatgcagttgggccttcagcacgaggctcaggtaagcggtcaaatttctcaatttcagggaaactaatatccaccactgaactttttccgccacgaatttggttaatcatttcaggcagacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgttcacgaatatgttcaccttcttgtgaagctacgcaaccacccacaccgataattaaatcaggtttatcttttttccagtttttccagcgaccaagttgagagaacactttttcttgtgctttttcacggatagaacaggtgttaagcagtaatatatctgcttcttcaggattttcggttaattctaaaccgtgtgtgctatttaaaaggtctgccatttttgacgagtcatactcgttcatttggcaaccccaagtggtaatatgtaattttgccattttcaaataatagataaatcagtaagtaaaaaaataaaagtagagttgtttatcctttggaacagggtgtaccttattttacatgtttgtatatatcatcgctataaaaaagaaaaccacgaccaaaactcgtggtttttattcaagtagtgtaactattttgttaaaactaaaacagtactttcacctgccacaacttctccagacaatttttgaagatttgttacttcatccatatttgaaattacaacaggtgttaatactgattttgctttagattgaagtaattcaagatcaaatttgatgataggatcaccaactttaacctcttgattttcttctgcaagacgtgtgaaaccttcgccttttaactcgacggtatcaataccgaagtgaacaaaaagctcaacaccatcttctgactcaatagagtatgcgtgattagtttcaaagattttaccaatcgtaccgtttactggggcaacaatcatatcaccagtagggcgaatagcaatgccatcacctacgatcttttccgaaaacacaacatctggaacatcttcaatatttacaatttcacctgaaagcggtgcatagattttcacttccttcgcaacagcttcttttttgccgccgaatagtttgtcaaaaaatcccataatttaatctccattattaaatgaacaaaattctcgcatattttatacgagaattttgtgtttgtattcaattttagttaaggttttggtaaaactcatcaactaaacgttcaatatctgttgctgttggttgtgcaagtgctttatctgcaagagctttggcatcagcatagttgatactgcgaacaagttttttcacatgaggtactgaaattgcactcatactaaattcatctaagcccatgccgagtaataaggcagtcgctttgacatcgccagccaattcaccacacattccagtccatttgccttctgcgtgtgaagcgtcaattacttgtttgattaagttcaagacagatggggttaatgggttgtataggtgagcgataatttcattaccacgatctaccgctaaggtatattgcgttaaatcgttagtaccgatactgaagaaatctacttcttttgcaaggtgacgagcatttacagctgctgatggtgtttcgaccattacgccaatttgaagattttcatcaaaagctttgccttctgcacgaagctgagctttaagctctgcaataatgccttttaattcacggatctcttccacagaaataatcatcgggaacatcaccgcaagtttaccaaatgcagaagctcttaatacagcacgcaattgagtatctaaaatttcacgacgtactaagccaatacgaactgcgcgccagcctaagaatgggttcatctcttttggtaattctaagtatggtagctctttatcaccgccgatgtccattgtacgaagcaccacgagcttaccattcattgcttcaacaatttctttataggcttggaactgttcttcttcaccaggtaactggttacgatccataaataagaattcagtacgatataaaccaacgccttcgccgccgttacgcaatacgccatccacatcacggatagtcccgatgtttccaactacttcaatgcggtgtccgtctaaggtttccgctggtaaatcttttaatttagctagttcagctttttcttctgcaattttggtttgtaatgcttttgctttttcaagttgttctgccgaaggattgatgtgaacttcattgttaatggcatcaagaattaaaatgtcacctgtattgactaatgaagtaatattgtttgtacctacaacagcgggaagctctaacgaacgagccataatagaagtatgagatgtgcgaccgccaatatcagtaacaaagccaagcactttatctaagtttaattgtgcagtttcagatggagtgagatcgtaagcaacaaggatagcttcctcttggatatcaccaaaatcaacaatattcatacctaaaatattacggatcaagcggttaccaatatcacgaatatcaccagtgcgctcttttaggtattcatcatcaatttccgcaagcatcgatgcctgcatatcaatgattttacttgcggcaacatcggcagttacaagattttcttcgatgtagcctagaatttcttcttctaattcttcatcttccaagatcattaaatgaccttcaaagattgcttctttttcttcgcctaacgtgcgtcttgctttttctttaattgctgtaagttgtgctgctgctttttcacgtccagtaaaaaatttacttttttcagattcaatttgagtgggtgtaattttatgtgtattaagaacaataggttcttctttcagaactaaggctttaccaaatacaatacctggggaagcggcaatacctgtgatcataaattaatcctcggctagaatttagtagatgctaaatagcacgaaagactttaccattgaataaaatggtaaagtcatcaatatcaaaaggacaactattctaaagtagggattaaatctactaagaaatctacagctttctgttcgtcttcgccttcagcagaaagagtgatgatagttccttgcgcaagacctagggtctgaagtttaaataaactttttgcactggcacttttaccattagatgtgacagtaatatctgaagcgaagccttttgctgcttttacaaattcagccgcggggcgtgtatgtaagccattcgggcaagtgattgttacatcttttgagtacattgttggttcctctgttgtatatcaaataataaatggaggactttttagggaagagcctccaaagtaagtcacgggattactttactacaaaatcggtataaaaacacgataaaagagattaaataaatgataaatgtcaattattagtgtgtattttaatcaatttataaaatcgtttgcgtattttatgaattatgtgttttattttcttttttatagaattattgattgcaattacccttaaaatcttgtatttatccatactttcaattcaaacacaacttcaactttttaggagcataaaatgcaaaatgtaggttttatcggatggcgtggtatggtggggtcggttctaatggagcgtatgattcaagagaacgactttgcgaacattaaccctgttttctttaccacatcacaagcgggtcaaaaagcccctgtttttgcaggcaaagaggctggtacattaaaagacgcttttgatattgcagaattacaaaaattagacattatcgtgacctgtcaaggcggcgattacaccaacgaagtctatccaaaattaaaagccacaggttggaatggttattggatcgatgccgcttctgcactgcgtatgcaagatgatgcgatcattgtgttagacccagtaaaccaacacgttattaccgaaggtttacaaaaaggcattaaaacctttgtgggcggaaactgtactgtgagcttaattttaatggcaatcggcggtttattcgagaaagatctcgtggaatgggtgtctgtggcaacttaccaagcggcttccggtgcgggtgcgaagaatatgcgtgagttactggtacaaatgggcgagttagaagatgcagtaaaagcagagcttgcagatccagcgtcatctattttagagattgaacgtaaagtgaccgctgaaattcgttcagaagatttcccaacggcaaactttggggcgccacttgcaggtagcttaattccttggattgataaattattaccggaaacaggacaaaccaaagaagagtggaaaggttacgcagaaaccaacaaaattttaggtttaagtgcaaatccaatcccagttgatggtttatgtgtgcgtatcggtgcattacgctgccacagccaagcgttcaccatcaaactcaaaaaagatttaccattagcagaaattgaacaaatcattgcagctcacaatgaatgggtgaaagtcattccaaatgatcgtgaaacgacgttgcgtgaattaacaccagcgaaagtgactggtacattaactgttccagtgggtcgtttacgcaaactagcaatggggccagagtacttagcggcatttaccgttggtgaccaattattatggggtgcggcagagcctgttcgtcgtattttagtgcagttagttaaataatcttttcatctaatgatcaagcggtcagattattgcaaaatcttgatattatgtaacagttgcgcagaggcttcatccgcttgatgaattaatttctgatacagtataatcgagtgaaacggcattgtgcttgcataatgttgatagcttgatgaagtgttgcaatctcttcatccaccaatgctaaatgttgtaacacttattttagttctcattgtaactcggtcagttttttcttaaatcaatgtaggttcaaagcaattttcaccgaaaaatatagtatctgactttaaatccacatcacatataacacaaaacttgtcaaatagtttatatgatgccatttgtactcataaaacacaaaaaacagaaatgctaatggaagaatggcaagttttgtttagattatctgagtctgataaaggtcaaaatcaagatatagaaaaaagaagaaaaaaaactatcggaaatatttagtgataacattaataataatgagaaagaatatctggctctctatgttcttcaaacatcttatgcgataattgtgaaattaatagcatgtaaagtcattcaaactctttcgtttagtgaagatgttaagtttttctcagatcttagtattattgattctattaaattacaacgttttatggagaaacttgaagatggatatgttttttctagtggtggaattagaaacttactggaaggtgacttctattcttggtattcagataaaaaccaatggaaccaaaaaatatataatagtataaaaaatataattaaagagttagagttttattcaagttcaaattttagttatgaatttcagacgatagatatttttaaagatttatatatggaaataatgcctaatgaaattaggcatagtttgggagaatatttcactccatcttggatggctgatcatgttgtatctcgttcacttgagaaactaaacaaagaatcttggaaagctatagatccatgttgtggaagtggggtatttttaatatcattaataaaatcgatactagataaacacgaattatatagtttaactataaaagaaaaacaagagttattattaagaatactatcaagtgtatatggtattgatttaaacccactatcagttttaactgcaagagttagttattttttggctataagaccattaattgacgaacaaaaaatagaaatccctgtctatcttggtgattcagctaatataccacaaaaattgaactcgataatatagcttgttatacatataccgtagaaacaaaacaaggggattttaatattatttttccttgtaattttgttgaaagtagttctttttttgaaagaatgtatcgtttacaaacaacagtagaagctgaagaccctaaattattataccatcaaattattgaaaatatagataaagactctatcaataacaagatcaaacaaagtataaaaatattgtcaagtaaattggttgaattacataaaaatgaatgggacggtatttggattagaattacatcaaactttatgctaattgcaagagttaaagagatggatctaattttaggtaacccaccttgggtaaaatgggaatttttaccccaaaattacgctgaaaagatcaagagtttgtgtattgatagaaaattattctcaggtcaaagttatatgggagctatatcacttaatttatgtgctttaattgcaaatgttacatcagataaatggctaactaataaaggcttactagcattcttaatgccaaaaacaattatgactcaagattcttatgctggtttcagaaatttttatttatctgatggtagtcgaatgtatttaagtgaaatagatgattggtctaatgccggaaacccttttattgtaactaccgaaaagtttatgacatatttttatgaaaaaaatcctgtagattactcaaatgggatacctataaatttattctataaaaaatccaatgtgaaaatcacagaagtaaatagatttcatacatttgaaaaataaaagatttctttcaaattaaagatggaatggcttatcaattaagcgaaaatagaacgggatttactttactccctgaaagagattatacaattttaaggaagctaaagttaatttctggaacttcagattataaagctaaaagctaggagtggtgttgagtttacgcctgctgaggtttacttcattgaacctgagaaaagaaccagtaaaaacactttttattttagaaactctgaattcaaaaattcagtttacaaagtggctaaaaactaaattcacattttaaatttatataaagtttggaggtgtttaagcgatttcaatgcgccgccatttgaatgtgaactataagaccgattttgtcctttgccataaattacgtgaagtgccattcaaaactcgtgatttaagcccattacaaggtgaaatcctcgcagatggtgcctaggttaattttaattgtgcaacactaacttcgccaaaaatcgctataaatagtaacaaaaagccgataaacaatggcgaaaatttccaaagttcaggcagactaagcgttgtattatcagtctcaatcaacgagctttcaatgatgattgtggggttcaaatggaactattgtggcgatgaactatactgaaaatgccagaacaattttagcattaaaccaccaattcgtgaaacaaggtggtaatattatgtgtgatgaaaatatggcgtatcaaacctatataccaaaaaacataggctaacctagtaaattctcatataatataagcatctttaactatttatggactatttatgataatatcatccccccttatagctattgtctctggtgaaatctcaggcgatattttaggtgccggattgattaaagcactcaaagtacattatccaaatgctcgttttatcggcgttgctggtgagaaaatgttaaaagaagggtgtgaaaccctgtttgatatggaagaactggtggtgatggggcttgccgaagtnnnnnnnnnnnnnnnnnnnnnnnnnnnnnnncgtaaacaggtgattgatacaatgctggtattaaaaccggatatttttatcgggattgatgcccctgattttaatcttggtgtagaagaaaagctgaaagcccaaggtattaaaaccattcactatgttagtccgtcagtgtgggcgtggcgacaaaatcgtgtacataaaattgctagtgcaaccgatcttgttttagcatttttaccttttgaaaaagccttttacgaccgttttaatgtcccttgtcgttttatcggtcacacaatggctgatgtgattgcgttgcaacctaatcgacaagaggcttgccgtttgttgcaattagatgaaaaccaacgttatgtggcgattttggttggaagccgtggaagtgaagtgaatttcctgtctgaaccatttttaaaaacggcacaattacttaaagctcaataccctgatgttcagtttttagtgccgttggttaatgaaaaacgtcgtgaacaatttgaagcgatcaaagcacaagttgctccagaattagaggtgataaccttagcaggcaatgctcgtgctgcgatgatggttgccgaagcaacattattagcatctggcactgctgctcttgaagcgatgttgtgtaaatcgccgatggttgtaggttataaaatgaagcctttaacctattggttagcaaaaagattggtaaaaaccgattatatctctctgccaaatttacttgcaaacgaaccgcttgtcccagagcttattcaagcggattgttcccctgaaaatttagcgaaacannnnnnnnnntatctatctcagatgcccgaagatgtggcgaagaagaatgcgttgaaacaacgttttatggaattacatcaatatattcaatgtgatgctgatgctcaagctgcacaggctgtggttgatgtcttgaatagagagtaaaaacgggcgatttttgcccgttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttgcccgttttatataacatcaataatctacgagtgatttttgatctgccccttctttctctaccacaggctgaatcatatgttcacgtttcaagcccaattcaagagcaacacctactgccacataaatggacgagtaagtaccgaaagcaataccaatcaataatgccagtgagaagctatgtaatgttgggccacctaatagataaagtgagaataccacaaatagcgttgtaacagaggtcatcaatgttcttgataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaagtgaaatatccacaatttcgactgaatttgcccgacgaattttcgggaagttttcacgaacacggtcaaacaccacgatactatcgttcaaagaataaccaacaacggataaaatcgcagccacgaaagtaagatcaatttcaatctgtaagaatgagaaaagaccaatagtcaccattacgtcgtggaacaaggctaaaatcccccctgttgctaaacgccattcaaagcgaagaccaacgtaaatcagcaacattgcaagggttgctaatgtgccgtaaatcgccccttgggttaattcttcaccgacatttggaccaacgaactcaatactttgaattttagcttctggatctaatttttggtgaattaaatccattaccgtattccccaaagatatatcgccagccgaagcaggtaggcggatcattacatctttttgtccaccaaaggtttgaactaaagcactggtataaccattttctgttaatacttcacgaacctttgccaaatctgcaggctgtgaaaagttggtttcaattactgtaccgccagtaaaatccaatccccagttaaaccctttagtcacaatggtaaacacacaaagtgccgtaatgatcaatgaaaatacatacgcaatgtagcggtatttcataaagggaactaatttataaggtagtttaatttctacttctttttctgttgtttgaacagtcatttaattccccttagatccaaagttttttcacacgtttaccaccgtaaacaaggttcactaacatacgagttcctgtaattgcggtgaacattgagatcattacccctaatgcaagagtcacagcgaagcctttgactggacctgttcctactgaataaagaataatcgcaactaatattgtggttaagttagagtcgaagatactggtgaatgcaccattatagccttcgtgaattgcctgctgaatagaacgaccattacgaatttcttctttaatccgttcataaatcaatacgttagcatcaattgacatacctacagctaacacaatccctgcaataccaggcattgttaatgtagctccgattaatgacatcaacccgatggttaaaactaagttagctaataaagcagctgtcgtaaataggccgaagactttgtagtacaccacgcagaataagatcgttagacctaaacctaacatacttgcgtccataccttgagcaacgttatctgcacctaatgaagccccgatagttcgttcttcaacaatcacaatcggtgcgatcaaagctccagaacgtagtaatacagcaaggttttgtgcttcagccgcactattaatacctgtaatttggaatgagctacctaaacgagagttaatggttgcaacgttaatcacttcttcgtgtttttcaagaatcactttcccgtttgcatcacggcgacctgaatctttaaactcactataaagggttgccatcggcttacctacagcagattttgtcgcatttgacatcaaatccccgccttgtgcatcaagattaatactaacattaggcaaaccacgttcatctttgcccgaagttgcattaataatatgctcaccacctaaaatggttttgcgatataacaccgtcggcataccatcacgactatatttaatctccgaatccgcaggaacaataccacgagccgcagactctaagttagcattaccattgactaaacgaaattcaagagttgcagttgcccctaaaatctctttcgcacgagcggtatcttgcacccctggaagttcaacaacaatacgatctgccccttgacgttgaatagtcggctcagacacaccaagttcttccacacgcttacgcaaaatcgacaagttttgttcgatagctaaatcacgagaagttgctaacccctgagcagattgagcaaaacgcacaacggttggagaaatataagttgcttctaaattaggattagtacggcgaatataacgaactgctttatctgcagtatcggtatcattaaattctacatctgttgcaaaattttctgcttttttaaccgctttgtattgccatttttccttacgaaaatcgttacgcaaggtatcttgtagctgatcttgctgtttcgccaatgccgtattcatatccacttccattaagaagcgaacaccgccacgcaaatccaaaccacgcttcatcggctcaccaccgattgaagttagccattctggcgttgcaggcgcaaggtttaaagcgacagaataattattgcctaagacttcagcgattttttccttagctggaagctgttcctcgtccttatttaaacgcactaaaatcgaaccattttcaaggttcatcgccttaggcgtaatatttaatgaagcgagtgctgattgaacttgcgtcagcgtttcagctgaagcttgttgccctctagtaccggaaacctgtaccgaagggtcttcaccatataaatttggaagggcgtataaaatgccaatggcgaccacaaggatcaccattaggttcttccaaagagggaaacgatttaacacgataagtcccctttcttaaaggaaaaaattaaagagatttgagtgaaccttttggtaacactgcaactacgaaatcacgtttgatagttacttcggtagtatcgttcaatgcgatcacaacattatcattatctgcagttactttagtaattttaccgattaacccaccgcttgttagcacttcatcaccttttgataaacctgctaataattcacgttgttgtttttgacgttttgcttgtggacgataaatcataaaatagaagataagaccgaaaacaaccaaaataaagatcatttccattccgccgccttgttgcatataaagctcctttaaaattattaactaaatttagacttcatctcaacattgagataatcactcactaaaataacataaaatctaccgtttaacgagtggaaattcagacaaatctgctgatcggctttgtttctgttaagttttaggataatctcacaaagtattgtgtcaaatcattgaaattcaatcttaacaaggaaaaaagatgaaaaaaatcgtattacaagcggcagtatcttgcctatttcttacaaatgttgctttcgcccataatgtacaattaaaccaaacgttaccaagtgttaccgtgcaacaagatggcgaattaattgccaatggtaaaaaagtcgattatcgccaatggcaatcttcaagcctagctggaaaggtgagagtagttcaccaccttgctggcagaagtagtgtaaaagagaaaaatcaaccattaatggacgcaattaaaaatgcagggtttgatcgcagtaaataccaaaccacaaccattattaatgcagacgatgcgattgttgcaacgggagcatttgtcaaaaatagtgcagaaaacggtaaattggaaaaccctcactctcaagtcattcttgatcaaacaagtagtgtaaaaaatgcgtggaaactgaaagagaaagagagctttattgcggtattggataaaaacggtaaagttcagtttgttgctgaggggaaattatctgatactcaaaaccaacaaattattgaattagtgaacagattaatttcccagtgatagataattccacaaatggagaaaaatggtgcaaatcgcttctagtgttacactacaagcgatttgttatttcaattattttacgatttattttgtatccaattgtgggatcacattattctgaacagaaagcaaacctgcctgtgtataaatacctaatttaccacgcgtatccacaatgtctaaattacgcattgttaattgaccaatacgatctgctggggtaaacggtgcatcttctactttttccatacttaaacgttctggttcataggttaagtttggtgattcggtattcagaattgagtaatcattgccacgacgtaattctaaagtcactgtgcccgtaatcgctttcgccacccaacgttgtgctgtttcacgcaacattaaggcttgcggatcgaaccagcgaccttgatagagcaagcgacctaaacgtaacccattgatacggtactgttcaatcgtatcttcgttgtgaatacctgttactaaacgctcataggcaatatgtaataacgccattcctggtgcttcatagataccacgagattttgcttcgataatacggttttcgatttggtctgacattcctaaaccgtgacgaccaccaatgcggtttgcttcaagaataagctctactgcatcttcgatacgtttaccatttaatgcaacaggcacaccttcttcaaaggtcacagaaacgacttcaggcttgatttcaaccgtttcgtccccaaatgctacgcccataataggtttaacgattttaatgcctgtgctaagtaactcaaggtctttagcttcgtgagttgcccctagcatattagagtcagttgaatatgctttttcaacggacattttatagtcaaagccatttgtaattaagaattgtgacatttctaaacggccaccaagttcgtcaataaaagtctgatctaaccacggcttatagattttgagtttgggattagttaataaaccataacggtaaaaacgttcaatatcattgcctttaaaggtcgagccatctccccaaatattaacatcatcttctttcattgcagcaacaagcattgtccctgttacagcacgaccaagcggagtggtattaaaataaggcacgccacctgtcgaaatatggaatgcaccacattgaattgctgcaataccttcgtgagctaattgctggcgacaatcaattaaacgagcattctccgcaccgtattccattgcttttctagggatagcattgtaatcatcttcatctggttgccctaaatttgcggtataagcataaggcacggcacctttttgacgcatccaaagtaatgcggcactggtatctaatccgcccgaaaatgcaattcccactttttgaccaagtggaagcgtttctaaaattgttgctgacataaaacttcctaatattttttgaatgaaattaaaaaattctcgcaatcttaccgcttgcgttcaaagttcgatattctaacgcaaaagtgaaacacaatctattcaaagaaaaagaatttataggtcacaaaaaaacggtaagatgtattatcttaccgcctgtaaaatgcattatattaactatttaaattataaatagaatttctcaacaaagtttaatttgtcatcaagtttcaacactaacggctgaccggttgggatttcaaaatccataatttcttcatcagaaataccgatgatatgttttgccaacgcacggagagagttaccgtgagcagtcacaagaacacgtttaccagataacaatgctggtgcgatttggtcttcccagaatggtaaaacacgctctagggtgatttttaggttctctgcatttggcacaacatcttttggaagatgtgcataacgacggtcgttatgtgctgaatttggatcttgtggatctaaatctggcggagaaatatcataagaacgacgccaaatatgaacttgctcgtcaccatactgttctgcggttgcttttttgtctaagccttgtaatgcgccatagtgacgctcgtttaaacgccagtttttcacttgtggaatccaaagttggttagattcttctaacacgatgttacaggttttgatcgcacgggttaaaacagaagtgaatgcgatatcaaattcataacctgcatcaagtaattttttacctgccgcttttgcttcttcaataccacgctctgttaagtttacatcacgccaacctgtaaataagtttttagcgttccactcactgaaaccgtgacgaataaatactaattccataagttctcctatataaaataaattgatttaatgtctatttataacaaaaaatactttttttttaaagttaaacacaattaatttgaagataaaaatgatctatgacaaaaaataagatgtaataatttattcctatgttggtaagaatgctactatttgcttattgcgagcatagggtatttaaaatctgtctcacccgctccaaatcctccgccgtatctaccccaacttgaggggcttctttggctaagtcgagatgaattttctcgccgtaccataatgctctaagttgctctagcgactctagctgttctaatgccgttggttgccacgcaacatattgcttaacaaaacctgcatggtaggcatagatcccgatatgacgaagatagttttgttgttgaacaaaagcatcatcacattgagggaaataatcacgtccaaaagggattgttgcacgagagaaatagagtgccattccgtttttatccgttaatgttttaaccacattgggattaaatagctcttctcgtgttgtcaatttaaccgcaagggttgccatattgacttgatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatctaaattttcagccacttgtgccacaatcaaaggcggaataagtggttcatcgccttgaatattcacgataatttcatcatctgcaatcgccattttttcaatcacttcggctaaacgttctgtgccagaattatgtttatctgacgtcaagcacacttctcctccaaaccttgtaacaacctgttcgatttcggggtgatcggtcgcgacgattacacgagtggctccagattgttgtgccttttcccaaacgtgttggatcatcggtttacctgcaatatctaacaggggcttacgcggtaaacgtgtagaggaataacgagcggggataatgacggtaaaactcataaaatctcctaaatgcgactaagatcaaatttcgctaaatcaatatgatttggcgtgccataaaattcacacaaggcttggcgaagttgttctgcacgtttgggtaagcctttttctgcatagattttaacttgttcataaacggcttgtttgaaagcagaattatcgccagcatcgcccgttaagttatcagcactggcaaaataacggaaatttgctgccgtagctaacacccattcaatcgcttgcggttttacttcgacttgttcaaattctctttggcgttcagcagagcgtccatcgggttcataccagtaaccaaaatcttctaatttacggcgttctgttccagcaactaaccagtgagcaatttcgtgtaatgcactgctgtagtagccgtgagcaaataaaataacattataagggcgttcactcgctacgttaccttcatcaataaaagcggggagataaatcggataatctccgccccgctctaaacgagtgttgtaactttctgcaaagcaagcgtcaaagatacgaataagatcttcataatcgtgatcgttttggttcattgtaaatcctatttgatgtaacttacaaaatcagtaatttcttctgttttgctagcggtggcaatgctatccccctcaagtggcgagccaaccagcagtaatgcgacaatttcatcgtcagcttgacaaccaaaggcctggcgtaaagcctgtcctttaatccacttattggtaatccagcaagtttcaaagccttgaacgttggctgcaagttgcattgcataggttgcacagcctgctgtaaccatttgctcccaagcgggtactttgggtaaatcttttgctattttagcgataatcccgataaccattggtgcgcgtttagctaatttttctgcttttgtaacaccttcatcacccatttcaagttcttgagcggtttctaacaggcaacgacggaaaatttccattgccgttggctcaatcactacgaaatgatagggctttaaacgcccgtgatctggtgctctaactgccgctttaaacatattttctagttgttctgcatttggtacatcttgaccaaattttttacttgaacggcgacgttgtagtaaatctaacgtttccattgagtatttctcgtgataaaaaatgggttaaagggtagcatattttgttaagtttcgctttgttttgttgattgtagggaaaaaggaggattggctatttatttaaaaataattttttagatttagcgatcctaaaattgtttgctgtacactagcagtttgagcacattattgtatagcttcatattgagcttcaaatatcgtaaacgtttgcttaagatccaattttcattatttgatcttgatcacattttttatgtgagattttccgcaagttattctaaaaatagtgtaaacttatcaagtttttcaggtgatgatatagggtgattttaatcatcgattagtcgtctaaacactattcatttttatattgattaattttaggagtcgaaaatggcagaacgtagagaacttgcaaatgctatccgttttttaagtatggacgcagtgcaaaaagcaaattcaggtcaccctggtgcgccaatgggtatggcggatactgcggaagtgttatggcgtgattttttatcacacaacccaaccaatccagcttgggcaaaccgtgaccgcttcatactttctaacggacacggctcaatgttgatttatagccttttacatttaacaggctacgatctttcaattgaagatttaaaacagtttcgtcaattacactctaaaacaccaggccacccagaatatggctattcaccaggcgttgaaaccacaacaggtccgttaggtcaagggattactaatgcagtaggtatggcgattgcggaaaaaaccttagcggcacagtttaaccgtgaaggtcacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagattgtaaatcactacacctatgcgttcttaggtgacggctgtttaatggaggggatctcacacgaggcttgctcattagcaggaactttaggcttagggaaattaattgctttctacgatgacaacaatatttcgattgatggtcacgttgatggctggttctctgacgatactgcaatgcgttttgagtcttacggttggcaagttatccgcaatgttgatggacacaatgcggaacaaattaaatttgcaattgaaaatgcacaagcagaaaaagatcgcccaaccttaattatctgtaaaaccattatcggttatggctcaccaaacaaatgtaactcgcacgattgtcacggtgcaccattaggtgatgcagaaattgcggctgctcgtgaatacttaaaatgggaacacgcaccttttgttattccagctgaaatctatgcagaatgggacgcaaaagcaaaaggcttgctcgcagagaaagagtggaatgcaaaatttgcagcttatgaaaccgcttacccagagcttgccgctgaatttaaacgccgtgttacaggtgaattaccagcaaactgggcgaaagaatcacaagcgtttattgaaaaattacaagcgaacccagcgaacattgcaagccgtaaagcatcacaaaatgcgattgaagcctatgcacacattcttcctgaatttttaggcggctcggcagacttagcgagttcaaacttaacattatggtctggctcaaaaccaatccgtgcagatcataatgttgatggtaactacatcaactacggtgtgcgtgagtttggcatgtcagcgattatgaacggtattgctttacacggtggctttattccatacggtgcaaccttcttaatgtttatggaatatgcacacaatgcggtacgtatggcggcattaatgaaacaacgttcattatttgtttacacccacgattctatcggcttaggtgaagatggcccaactcaccaaccagttgaacaaactgcggcattacgtttaattccaaatcttcaaacgtggcgaccgtgtgaccaagtggaatctgcggtagcgtggaaagcggctgttgaacgtaaagatggcccaagtgcattaattttcactcgtcaaaacctagctcaaatggaacgtaccccagaacaacttgccaacgtggctcgcggtggttatatcctacgtcaatgttgcgaaaaaggcgattgcccagatttaatcttaattgcaacaggttcagaagttgaattagcgatgaaagcagctgaggtattaagtgcagaagggcataaagttcgtgtggtttcaatgccaagcactaacgtgtttgacgcacaagatgaagcttatcgtgaatcggtattaccaagctcagtgaccaaacgtgtggcgattgaagcaggtatttcagatttctggtataaatatgttggctttggcggccgcattgttggtatgaatagcttcggagagtcggcaccagcaagtgaattattcaaactcttcggctttaccgtagataacgtggtagcgaaggcgaaagagattttgtaattacatagaatgtggcaaaataaggggattttatatccccttattttttagtttctatttgggtaatcagaaaatgaagaaaattcttgttattcgtaacgataaaattggcgattttatgctggcttgggcggcatttgcgatgttaaaaaaatcaatgccgaattgccaaattattgcccttgttcctaaatatacagcgccattggcggaaatctgcccttatttagatggtattattttggatagttcagataaacaaaataaagctgaaaatgaacgagtgttacaagcggtaagatcagmrcagtttgatgcagtgattagttttgtgtctgattggtataatgccaaattagtttggaaaagccgtattgcttaccgtttagcaccagccacgaaactctttcaatttttatataatcaccgtttaacccagcgacgctctcgttctgaaaaagcagagtatgaatataatttagacttggtacgttattttttaaaagataatcaaattacagcgattgagccaacaacaccctatttgtcttttgataatgaatgtttgaatatgcaaaaaagcaaattaatggaactgttaaagttagatggcaataaaaaatggctttttgttcatagtagtacagggggatctgcgacgaatttatctttgaatcaatatgcggagttaatttcagggattttagcgaaatttgattgccaagtgattttgacagcagggccaaatgaaagtgaaactgctcaggcattgcaacaattagtaaatcataagaatgtggtgatttacgataaaaatgatggattagtcgattttgccaaatcgttagcctgtgctgatctctttattgctggttcaacaggacctttacacatttgtggggcattaaatattacaacggtaggtttttacccaagtcgtttatctgccattccacgccgttggaagccgttaaatgatgccgataaacatatcgcattttgtccgccatctgataaggcttcgcaaaaaaatttaaccttaattccgatggataaagcattaacggagattctgccgtttatgagacaaatcatggataataaaaaattataggatagtaagtagtaatatgttttagttattactagtaattaaatgttattaatatagtattttttattgttacaatctatctacttttgaattagagaggctacatgcaaaaaagaatttttaattttatccagaaaaaatatttatgtactataagttgtgcaaagaataatattccttggtctaatgcattttattatgtatttgatgaagataatctgcgtttaatttttgtgacgagcttaacgacttatcatagtcaagtgatgttagagaatcctaatatttctggtacaatctttgtaccaacgcgttttcatccctctttacaaggtgttcaatttacaggtaaagcaagaaaattagagggggatgaaaaaaatattgctagagaattatataaaaaagaatattcacatgaacttattgataaattgtctatttgggaggcaaaattagagtatgctagattaattgataattcattaggattatttagtgtaatagaatggaatggggaagaatatttctaatatatagttttatactttcaacatcatagattcttttgagaaataaatttattagaacataacagtatgaatataaaaattcttattactggtggtgcaggttttattggatctgcaatgattaggtatattattaataatactcaagacttagtaattaatatagataaattaacttatgcaggtaatttaagctcattagaggagatttctaatagttctcgttatgcatttaaacaaatagatatttgcgataaaatagccttagagcagatatttaatgaatatcagccagacatagtaatgcatttagctgcagaaagccatgtagatcgttctattaagaattcggaagtatttattaagactaatatttggggaacttatactttattagaagtagctcgtaaatattggaatgatttgccagaggaaaaaaaatctatatttcgtttccatcatatttctactgacgaggtttatggtgatttaggaacaagtgagaggcagtttacagaaatcatgccttatgctccttctaacccctattcggcatcaaaagccgcaagcgatcatttagtgcatgcttggaggcgtacttatggggtaccaactatcgtcacaaattgctcaaataattatggtccctttcattttcctgaaaaattgattccattgatcatcttgaatgcaatagaaggaaagaaattaccaatctatggtaatgggttacaagttcgtgattggttatttgttgaagatcatgtgagagctttatataaggtaattaaagaaggtagagtgggagaaagttataatattggtggtgatagtacgaaaagtaatctggaggtggtttatgctatttgtgaaatattagaagaattacttccacataagccaaaaggggtacagaaatataaagatctaatttcttatgtaccggatcgtctagggcatgatactcgttatgctattgattcaactaaaattcgcgaagaattagattggaaacctcaagaaacttttgaaagtggaattcgtaagacagtagagtggtatttaaataatcaaaaatggtggaaaagcataagaaaaaataatttttcgtattcttgttaaacaaaatagatattcattccttagcaacattctgaatgattaaacttaagaatacctttggttattttatcgctgtagagtgaatttgctaattactattttaacaaaagttattgaattttatcttctttcaaatacttatgttataaatgagtaagcctatctattagtggatcttcaaatataaaccctgcagattgtaatttgtgaggcacaagcggttgattatctaataacaattgcgaacgttcacctaataaccattttaagatccattcaggcacagtaaaaaaggctggacgtttaaggtgttgagccaatttttgattgagggcagaattagtcagtagatttggcgacaccaaattaaaagcaccactacattcgaaatgattgagtagaaataaaattgcccgaatttcatcatttagcgaaatccaagcccagtgctgtttaccggatcctagctttccccctaaaccgaaacgataaagcggcaacattttttgtaatgcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcctgttttgtctaatacaatgcccgtgcggataagacaaactcttgtcttattactctgagcttgtaaggcggtcttttcccattgaaaacagagctgagcaggaaaagctgtaccacaagcggtttgttcatcgtaatgttttccttccgccaaattgccataaaaacccgttgccgatcccgaaataaaggtgtgaggaggcgtatcgctcgcttgaattagctcgactaaacgctgggttatactaagacgactttgtattaatttttgtttctgtgctgtagtccaagctttgttaaaaatcggctcgccagcaagattgatcaccgcatcgaatgtatttaaatgctggaaagcggtaagatcttggcaaaaacttaccgcttgttgatgaggtagcctttggcgagtcagtacggttagctgatgtccttgcttgattaaagcctgacaaagtacttttccaataaagcctgttccgccagtaatcagtatattcattagagtgagctatcaaaaagttcagtaatggttgcaattaatgttgaaatagaggtatcacgagttggggtaatgaaaatcgtatcatcgccagcgatagttccaagtatgccttctgcttttcccattgagtccagtaatcgagcgatcaactgtgcggcaccaggacttgtacgaacaacaatcaaactttcattatggtcgatatcgatcactaaatttcttagtgggcttgacgtggttggaataccgagttctgctggtaagtgataaaccatttccatttttgtatttcgggtacggactgccccaaatttactcaacattcgggatacttttgattgattgatatgctcaaatcccatttcttgcagagcagtgacaatttcgctttgtgaaccaaatttttcttctcgtaataatgatttaaaagcttcgttgagagagtcgagtttttccacttgttatccttttatttttatgcaattacagccgtaaatatgcagaattgttgcctatttattcacggaaatcaatctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggaaatcaatctaaactcactttttttctcgaaaatttgcggtaagtctcaaaattgtattttggtatttgaaagttactatgaatttacatacactttcgctattaaatttacataacctatgaggagaaacttatgaaagttgcagtattaggcgcagcaggcggtatcggtcaagcattagctttattattaaagttacaacttccagctggcacaaacctcgcactttatgatattgcccctgttaccccaggtgttgcagttgatgtgagccatattccaacggctgtaaaagtagttggctatgcaggcgaagatccaacaccagctttagaaggtgcaaatttagttttaatttctgcaggtgtggcacgtaaacccggtatggatcgttctgatctgttcaatatcaatgcaggtattgtgcgtaacttaattgaaaaagtcgcaacggtttgtccgacggcttgtgtgggaattattactaacccagtaaataccacagtagctattgctgcagaagttttgaaaaaagctggcgtttacgataaacgtaaattattcggtgtgacatcactcgatgtattacgttcagaaacctttgtggctgaattaaaaggcaaagatgtcaatgatgtaaaagtacctgttattggtggtcactcaggcgtaaccatcctaccactactttctcaagcatttgaagaagataaaattgactttactgcagaagaagttgcagcattaaccaaacgtattcaaaatgctggtacggaagtggtggaagctaaagcaggtggcggatcagcgactttatctatggctcaagcggctgctcgctttgctcgttctgtgttaaaaggcttaacgggtgagcaggttgttgaatacgcttatgtcgaaggcaatggtgagtatgctcgtttcttcgcacaaccagtttgtttaggcttaaatggtgtagaagagttgttacctatcggtactttaagtgcttatgaggaagaggctgttcaagcgatgatcccaaccttaaaagcagatattgagttaggcgaaaaatttgtaaacggttagtcttgaatttatcgtaaaatcacgccatgatacaagggctggaaacttcagttttcagcctttttatatactactatggtgtactaatatggattatcttattaacgtcaataacactaattttagtgaagttattaaagctgcagcagaagtccctgtcgtttttcattttatttctccccgtgagcctcgttcacttgaggtggaggcttgttttcgtcgtttaaacgatgaatattcaaaacaatttctccttgctatcgtcaactgtgatgaatacccgatgattgccgcacaatttcgcatacaagcggtgcctacaagttatttctttgcaaatgggcaacctgttgatgtgattgagggtgagataaatgaacaagaattgcgagttcgtctaagcaacattttacccaaagaggaagaacttcaattcgctcaggcgcttgaatttctagaagcagaacagtatgaacttgcgttaccgttattaaaaaatgcttgggaactgacgcataagaaaaacagtgattttgcgttactctatgcggaaacctatattacaatgaagcaagttgaaccagctaaagcaatcttgatgcaaattccaattcaagatagagatagccgttggcaaggtttgcaagatcaaattctattactagaacaagcggctaattccccagaaattcaacaactccaagctgattatactaagactaaaagtcctgagattgccgtaaaattggcaaatcagttacatcaagttggtaggaatgaagaagctctagaattattatatgattggttgaaacatgacctttcagcaggtaatggagaaattaaaaagcaatttctcgctattttatctgcaatggggaattccgatcctcttgttcctaaatatcgcagacaactttactctttattgtattagttttagtaagtgatttttcatatatttaggagaacaaaatggcaacaaaacacgcaaaattattgattttaggttctggccctgctggttacacagcggcagtttatgcggctcgtgcaaatttaaacccagtattagtaacgggaatgcaacagggcggacagctcactacaactacagagattgaaaactggcctggggaatttggcgatattacaggttcagagttgatgaacaaaatgcaaaagcacgctgagaagttcaacactgaaattatttttgaccatatcaacagcgtcgatctttcacaacgcccattcaccttaaaaggcgactttaatacctttacctgtgatgcgttaattatcgctacaggtgcgtcagcgaaatacttaggcttgccttctgaagaggcttataaaggtcgaggcgtttcggcttgtgcaacctgtgatggtttcttttatcgtaataagccagtagcagtaattggcggcggaaatacggctgtggaagaagcgttatatctttcaaatgtagcctctgtggtacatctagtccatcgccgtgatacttttcgcagtgaaaagattttaattgaccgcttgatgaaaaaagtcgaagaaggcaaggtgattttgcacacccacagtgttttagatgaagtgttaggcgataatatgggcgtaactggagtgcgtttaaaatgtactcaaacaggtaatgaagaacagattacgcttgacggcgtatttgtcgcgatcgggcattcaccaaatacggaaatttttaaagatcaactagagcttaacaatggttatattgtggttaagtcaggtttagatggcaatgcaaccgcaacaagcgttgcaggtgtattcgccgctggtgatgtgatggatcataactaccgccaagcgattacttcagctggaacaggctgtatggcagcgcttgatgcggagcattttttggaatattgctcataacttttgatatagtagacaaaatagttgctaatgtttgttttctttaaatattagcaaccttgtctattacatctagatcgtttgttcccagtattttcctcattgtagggagcaatatttcagtcacaattatttgttgtgctcaattttattaagataagaatatgtgttaagaggcagaaaagtaaagtgggtagaatccttcagatgattatttctgatatttattccacaaatcagcatacttcacaaaagtagaatgtgccgacagaacggcaagtaaaaaaccttgcttaccatcaagaaaacctgcttttaaaatatacatttttacaaaacagccgacagcgtgggtaacaccttggaataaagttgcttttttgccagctttggctctttgctctgaccaagccttagcgtaacttgctgattttactagataatggtgaatatctttataagtaaaatgcaataaatcgcctttaagtttagcgactttggcttcttttggataatggactttttcgtgaacaagttcatcgccgtattgagcaaaatccgtacggtaaagtctcactacataatcaggataccaccctgaatggcgaatttgcctgccaaaaacttcacttaaacggggaatttgataaaccgtgttaggttcattactacttaccgcttgttgtatgctctgttttaattctgaggtgacacgttcgtcggcatccagccagaggacgtaatcgctggtgacatattgttgagcgagttggcgttgtttaccaaaaccttgccaatcggtattttcatagaattttgctccgtattgtaaggcgatttctttggtattgtcgctacttccagagtctagaatgatgatttcatccacccaacctttgatagtttctaaacattgggcaagatcttgcgattcgtttttgacgatcattgcgacgctaagcgttggcataggttatcctttttgaaattaagtcagtttcgcctattttagcatatctttagctttaaaatttattctgaatatgctattttctacgccgatttttttagcatagaaaggcaattttaatgtcagtaaatttaacaacaaaacagaaacaatttttaaaggggcttgcccatcatttaagtccagtcgtgatgcttggtggtaatggtttaaccgaaggggtgttagccgagatcgaaaatgcgttagatcaccacgagttaattaaagtgaagatcgcaggggctgatcgtgagatgaagcagttgattattgatgcgattgtacgtgaaaccaaagcggtgcaagtgcagaccattgggcatattttagtactttatcgtcaaagtgaagagaagaaaatcagcttgccaaagatagctaggagcatttaatcaaatcttcaggaatagatgtttgtaagcacagtgatatattcatagggacagagaaattagttaatacttagaatgttgtatgaataatgaacaaaatataagcctgttactcaaacaaaattttgcatcaggattagtcgtttttcttgtcgcattgcctttgtacttaggtattgcccttgcatcaggagcgccacctttagcggggattttatctggggttattggaggtgtcatcgttggcacattaagttcttctcatattagtgtttctggacctgcagcggggttagcagcgatgacagaattgggggctttcgagttatttttatgttctggtgtgattgcgggcgcactgcaattgcttctgggttttcttcgagctgggagtatctcaaactatatacctatttctgtgattgaaggaatgctggcagggatcggtgtgattattatccttaaacagttaccttatgctcttggtagtgatgatacattaattgaaattgttcattctactggacgggttcatttagggtctttggttgttgcagtagttgcgcttattattatgattggttgggaagagcaacctcgattacgttaactcaaattactcccttctgctttagttgccgttattgtggggattttacttaaccagcttttcatatggttcaacagcccgcttgcaattccaacaaatcaattagttcaactaccagtattaaactctttagatgaagtaagttccttaattcgctttcctagcttagagggtttcaacaatagcatagtctggattacagggggaactattgcagtagttgcctctgtggaaacattactttcaattgaggctgcagatcgtttagatgttcgccgtcgaattacggataataatcatgagttacgagtacaaggttttgctaatatattaacctcttcgataggaggtttacctatgacatcggtcattgtgcgttcttctgctaatgcaaatgcaggagcgactcataaatcatctgcggtatttcatggtgttttgttgcttatgtgtgtattaactattccaagtgtgctcaaccagattccccttgcaacgctagcggcagtattaatattgattggatataaattgacacatccaaagcattataaacatttttggtgtaaggggagttatcaatttattcctttcgttgcaacaatggtttctgttgttttccttgatttgctgaaaggggtagggattggcttagtgattagtattctatttattctgcatggaaatatgaaaagagcttattacttgagctaggtgaagaagtctcttttttgaataaggcaacgattaagaaaactttaaaaaatattcaacctaattcaaaagttacaattaatgccgagcgggctttatatattgcaagtgatgtattggaattacttgaggactttaccagtgtatatgctcaagaaaataatattcaggttaaattgcgtggttttaaatatgactatgaacatcaggaagggagagagcatacacatattcgagttgagcatcgaagccggatttagccataaaggagtggtagaggaaatatagaccttagttcttattttgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgttttctgtatacatatctgatttgattctccgcttttactttttttccaaaaaatgttaaattgatcacatttttaatccattgagataatcactgatgaaagagctgatcttacctaaaataagtcaaaacttagcaagctcatctcttttccaagatcaattatcttatataaaacatcgagttgatatgctcgatcagttccgtattcataacacgttacgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattccgaagctttccaaagcgttttttcattattacccgctttattacactataatattccaagtttgcctgcgtatgttgaaaatgcgccaaaaggtatttttaatttcaacttatcggctactcagaaagctcatttgtctacttattttcccttgcctgaagatacaaaaaatattgcttttgatggtttgtatgtgatggggagcattgggtcaattacgcaaacctgtttatcagatttggatctctggctttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctctgcattagcgattgatgaatatttcggggcaagtctttggcaactttataaagggattgaaagtccttataagtctgcgattaaaattttattgttggaaagctatgcagaaacttaccctgaaacacaccttatttctaagaaattcaagcagttattgctttcaacagcagaagttagctatcattttgatccgtatttggctatgttagagcaagtaacaacatatttagaaaatcgtaaagagtttgttcgattagaccgcttgcgtagctgtttttataccaaggcttatgatggtcagcacgatagttggcgtaaagaagcattgagagagttggtgacgcagtggcaatggagcgagcgtgaaatcgaatgtttaaataattgccgtcagtggaaagtgaaaaaagcaatgacacatcagcagatgattgttgaacagttattgcaaagttaccgtaatttaattcaatttgctcgcaaatttcatattgatccaagcattttgccacaggataccgatattttaatgcgtaaactttattctgcatttgaagttgtgccaggtaaagtacctttaatcaatcaaaatatcgctcgaaatttagccgaagatgaagtgactttcattgaagtcaatgaaggtgtttcaactaaagcaggctggtatctgatcaatcacgccccgttaagttcctatgactcaacaacccgtcacgttcagtatcaacgaacacttatcaaatcagtggcttgggcttattttaatcgagttattacagcctctacgcaaattcacttggtcagccaaagcctccagctttcaaccttacgtcaatttattacagatttacgcctttcatttcctgtcgcaacgccagcattgaaagatgatgatctttatcacccaaatgaaattcgtaacctgattgtcgcgattaatttaattcaagatcccacaaaagctctcccttccttgtctaaaatggagatggcacaactggatctgtttaatttaggctcttcagagcaaggaatgattggtagtgttagcattatttatcgcaatatgtggaatgaaataatgacacagcactttgagggaaatgatgccattttgaaatccctcaagttaatttctaataaaatttatcgtaattctgcacctccacaatctgtcaatgtattttgttatagctgtcagctaagaaatgagttacaaaatgcagtaatgagtttggtcaatcgttgcattaccgtacaaacaggctctattttccaacgccagcaggcacagacattcaaaatggctggaaaaaaatggcaactgatttttaataaaaataataatttacaaaatattgttgccgatgaactcaacgatttgggtgatgagttgtcagagtttacaggcaatattcctaaagagatttatgattttgccagcgaaggctttttacaatttttctttgatgataacgccgacggtagttttaatgtttatgtccttgataaaaataaccagaccgaatgttattgcaactgtgttggggataaagaaaataaaatccgacgtattagccgatcttattcagacacggaaggtaccaaagaaagccttaatagctttaattttcctcagttttatcagctattaaaacaaaatgatatgattaaaattgtaccatttcagagtaaacaacatcgagaatttttagaacaacattaaaaataggaaagtttgtgtcctcaactttagctaaccccgaattgattaaaaccgtggtgttacttgcaacaagtattaccattgttccgctttttaaacgaattggactgggcagtgtattaggttacctcgtggcaggttgcttaattggaccttcaggtgcgggactattccaagatccaaatgcagttgtacatatggctgagcttggggtagtgatgttcttgtttattatcggcttggaaatgcaccctgagcgtttgtggagtatgcgtaaagcgattttcggtcgaggttttttacaggtcgctctatgtgggacattgctcacttttgcaggtatttttattctaggtttaccaaaagaagttgcgttcattgcaggaatgggctttacactctcttcgactgcgattgtaatgcaagtgcttgaagaaaaagggattagtaccacacctaaaggacagcgtatcgtttcgacattaatttttgaagatctagctattgtgccactattagcctctattgcatttttagcacctgaacaagctggagcagagcaagggacaaattggactgcgattggtgcgggcttagtgggagtgctgatcttagttgcttcaggtaaatggttaatgaacccactgtttaagatgatttctaaagctcacattcgcgaaatgatgaccgcagcggcattattagtggtattaggttctgctttgttaatggaattgagtggtttatctatggcaatgggggcattcgttgcaggggttatgttgtctgaatcgtcgttccgtcatcagctagaggcagatattgaaccatttaggggtttattacttggtctattctttatgggcgtgggaatgtccctcgatctttctctcgtactaaataattggttatggttactgggtgtgatattactttatgtggtaggcaaagggttatctatttatgttgttgcattagtcacaaaattaactaaccttgaagctattatgcgtacagcgattatgtcgcacggcggtgagtttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtccttttttctgctgccgctaccgcaggtgtttttacagcagataatcaagcgactttcacagcagcagtgattgtatcaatgcttttatctccattggtgatgatcgtcattcaacgtttagtgaatttgaaagtgaaaaaatccacaggagaagctcagccaaatttagagggcattgaatttgcagaaaatttagaaagtagtgttcttgttattggctttggacgttttagccaaatcatctgtcaagtattgttagctcgcagaattaatgtttcggtgattgattctgatgttgagaatatccgtatggcaacccgtttcggctttaaggtttactatggtgatggagcaagaattgacgtattaagagccagtggtatagcacaagcagactgtgtgattgttggtttagctgaacctgatcgcactttgcaaatattagaattaattaaacacgaatatccattagtgcctgtttttgctcgttcttacgaccgattcaatactgtgaatttaattaaacatcatgttgattaccaagtgcgtgaaaccttcgaatctgctttattgctgagcaaggtgacccttgaacgattaggtgcaacagaaacagaagctcaagatgtaattaatcttgttcgccatttagatcaggagcgtttgaacgaagaagtactacacggtttttccgatgaaattgcgaaaaaatattggcgagttgaacccttcgtaaaaccagcacacgaagcgacagctttaaatgaagaaactgcagatattttagaagaaattggcgaaagtattgaggtggttgaagttgaacttgatgatcagagtgaaatggaaaagattaagttcgcgactgatgaaaagaaagaagatgaattaagttaaaacaatttttagctatttgaaagttaaattactttataatttaactttaatatgaaatgtaagatagattaagacaatgattgaagctgacagaattatcagtgcctcagcaaagaaagaggacgaaaccatagatcgtgcaattcgccctaaaatgcttgccgattatgtcggacagccgtcagtgcgagagcagatggaaatttttatcaaggcggctaaattacgcaatgatgctttagatcacctgttgatctttgggccaccaggcttaggtaaaacgacactggcgaacattattgcaaacgaaatgggcgtgaatatccgcacgacatcagggccagtgctggaaaaagcaggggatcttgccgcaatgctgacaaacctagaaccctacgatgtgctttttattgacgaaattcaccgcttgtcgccagccattgaggaagtgttgtatccagcaatggaagattatcagcttgatattatgattggtgaaggccctgccgcacgttctattaaactcgatctccccccatttacgctcgttggggcaacaacgagagcgggctctttaacttcgcctttgcgtgatcgttttggtattgtgcaacgccttgagttttattccgttgaagatctcacctccattgttagccgtagtgccagctgtttaaacttaaatcttgccactaatgccgcttatgaaattgcacgccgttcacgcggaacgcctcgaattgcaaaccgattgttacgtcgagtacgagattttgcagacgtacgaaacaacggcattatttcctcggacattgcaaaacaagcattaacgatgttagatgtcgattccgagggttttgattttatggacagaaaattactctctgccgtcattgagcgatttgatggaggccccgttggattagataaccttgcagccgccatcggcgaagaacgggaaaccattgaagatgtgctagagccttatttaatccaacaaggctttttgcaacgtacgccaagagggcggatagcaacgtcgaggacttatagtcatctggggttggtaaaatctgaatagtgtaaatcggtagaatttttaaggttctgccgattgttttttgttttattcattgattttctttactcaagtcacatttttacaaataatctctataaaagtaacttaaaaactttacaaaattgattttttaagttactaattaacaatttttaacacaactaaaagcggagatcatttatgcaaacaactttcacccgttctttattagccagtgcagttgcacttggtctttccgtttctgcatttgcagctaaagtgcctgaaggtacggtgcttgcagagaagcaagagatcattattaacaatagctcagaaccatcaagttttgacccacataaaacagaaggtgtgccagaagctcaagtttcttatcagttacttgaaggtttagtcaccaaagattctgcgggcgaaatcattcctggtgtggctgaaacctggaaaagttctgatgatttcaaaacctggacttttaatttacgcaaaaatgcaaaatggtctaatggcgaacctgttaccgcacacgattttgagttctcgcttaaacgtttaggcgatccgaaaacggcttcaccttatgcaagttacttaaactatcttcaagttgaaaatgctcaagacatcattgatggtaaaaaagcaccgagtgagttaggagttaaagccgttgatgattacactttagaaatcaaattaagcaatcctgtgccttacttagtcggtatgatgacgcaccaaacgatgttacctgtgccaaaagcggtcgttgagaaattaggtgatgcgtgggtgaaaaaagagaactatgtaggtaacggtgcttataaattagttgagcatgtgattaatgaaaaaatcgtgtttgaacgtaacccattgtattggaatgataaagaaaccgtgattaataaagcgacattcttagcgattccaaatgcaagtactgatgttcagcgttatcgtgcaggcgatttacatattaccaactacgcattgccgccagagcagttcccgacattgaaaaaagaaattccaaatgaagtgtttgtaacccgtacgctttcaacttactactacgagccaaacaacgaaaaagcaccatttaacgatgtgcgtgtgcgtaaggcgttaaacttggcattagatcgtagtgtgattacggataaagtattagggcaagggcaaacgccaacctatgtgtttacaccgccgtacattacagaaggtcacttaattcaacaacctgagtactcaaaacaggatatggcatctcgtaaagcagaggcgattaagttgttagaagaggctggctttagcaaagcgaaccctcttaaatttacgcttttatataacactaacgagaaccataagaaaattgcgattgcagcacaatcgatcttaaaacaaaacacgggcggtttagtggatattaaacttgaaaaccaagagtggaaaactttcttagatacacgccgtgcgggtaactatgatgttgcacgtgcaggttgggcggctgactataaccaagcgtcgactttcggtaaatacttcttgtctaactcaagtaacaataccgctcgttataagagtgcggcttatgatgctgaaatcaatgcggcatataaagcgggtaacgcagaagaacgtgcggcagcttatgcaaaagcggaagctcagttagcgaaagattatgcgatcattcctatctataactatgtaaatccacgtttggttaagccatttgtgaaagggtatgagggtaaagatccgcaagataatattttattaagaaacctttatatcattaagcagtaatttttaagcggtgcgatttttaaaaatctttgcaaattttgccaaaaatcgttccgcttgttttcttttgttgtgtggatcggagaactgagcaatgttgaaatttataataaaaaggattttagaagcgattccaacgctttttattttaatcacattttcgttttttctaatgcggttagcaccaggtagcccatttacctctgagcgtgcttatccacctgaagtgatagcaaatattgaagccaaatatcacttaaatgaacccttatataaacagtattttatctaccttgagaacttagctcagggggattttggcccctcttttaaatataaagatcaaaccgttaatgatttaattgcctctgcttttcctgtttcatttaaactgggtattgttgctttttgctttgcggtaactcttggcttgctggcaggaacggtggcagccttgaagcaaaatagcaggtgggactactttattatgtcctttgcgatgacggggattattatgccgagcttcgtctttgcccctcttttagtgttaatttttgcgatttatctcaaatggctacccgctggcggttggaatggcggtcagctctattatatggtgttacctgttttatcgcttaccattgcctatgtcgcagggattgcgcgtattacgcgtggttcaatgattgaagtgctacattctaattttattcgtacggcacgagctaaaggcttgccgatgagtaaaatcatttttaaacacgctttacgcccagctatgttacctgtgattagctatcttgcccctgcgtttgtggggattattacaggatcaatggtgattgaaagtgtttttggtttacctggtatcggacagcttttcgtcaatggggcattaaaccgtgactattcccttgtgttaagtttaacgattttggtcggcacattaaccattttctttaatgcggtggttgatattctttatgctgtgattgacccgaaaattcgttattcataaggagtgtgagatgttaattaataataagaaaaatcaagaacttgcagaaaaattagcggaacagaccgctgacatcgccgtggaaggtcgcagtttatggcaagatgctcgtcgtcgctttttccgtaataaagcggcggtaagtagtctgatcattctcttttttgtggtgttattcatcacttttgcaccgatgttaatgccatttagctatgaagacacggattggaatatgatgagtgcggcacctgattttgcatcagggcattattttggtactgatgcttctggtcgtgacttgttggtacgaattgcaatgggcggacgaatttcgctgatggttgggattgcaggggcattgattgctgtggtgattggcacaacctatggggcaatttcaggctatgtgggcggcaaagtcgatatggtgatgatgcgtttgctcgaaattttaggctcgttcccatttatgttctttgtgattttattggtaacattcttcggtcaaaacattctgttaattttcgtggcaatcggtatgattgcgtggttaagccttgctcgtatcgtgcgaggacaaaccctcagcttaaaaaacaaagagtttattgaagcggcgattgtctgcggtgtgccgaaacgccagatcatctggaaacacattattccgaatgtattggggatcgtggtggtttacgcttcccttgaagtgcctgctttaattctatttgagtcctttttaagtttcttaggtttaggtacacaagagccgatgagcagttggggggctttattaagtgatggtgccgctcaaatggaaacatcaccgtggttattggcattcccagcctttttcctctgtttaaccttgttctgttttaactttattggcgatggtttgcgtgatgccctcgatccgaaagacaaataggaagttgcacaatgaaattattagaagtcaataatttagatgtctatcttaaaaccgatcaagaattggtacacgcagtgcgttcggtttctttcagtgtggaaaaaggacaaactttagcgattgtcggcgagtcaggatcagggaaatcggtcacttcaatgtcgataatgcaattgttgccacataacattgttacctatggcgaaaattcttcgattatttttgaagggcaagatattttacgtttctcagataagcagatgcaatcattgcgaggtgatcgtatcggtatgattttccaagagccgatgacatctcttaacccatttatgcgaattggggaacaggttgccgaagcggtgagtacccataatccattgctgagcaaacagcaggctcacgaaaaagcattggcgatgttacagaaagtaaaaatcccggacgctgagaaaaaaatggtctgctatcctcacgagttttcaggcggacagttgcaacgcataatgattgcaatggcaattatcaatgaaccagatttattgattgcagacgaaccaacaaccgcccttgatgtcactacgcaagcggaaattttagacttaatgcacgatctacaagcggatatgggaatggcgatcattctgatttctcacgacctccgtttagtgcataaatacagtgacgatgtatgtgtaatgcaaaatggcgaaatcattgagcgagggaacacagaagaggtctttaaaaatcctcagcacccttacaccattgaattgctaacaccgatcccaagtgatctaaaacatcaagtcgcagaaaatgccccacaactgatcacggcagagaacgtggatatagattacattttaaaacgcaatctatttggcaaaccgaccaaagtgtttaatgccgtgaaaaatatctccctagagctaaaagtaggcgaaactttagggatcgtgggcgagtcggggtcgggcaaatcgacactcgggcgagcgattatgcagatcttagcctatcgaggaaaaattgcctttgcagatcaagagatcgccgcattatctaacgaacagcgtcaagccttgaagaaagatatgcaaatggtattccaagatccgtttaactcactctctccacgcttgacggtaggggagatcatcggcgagggcttgtctgtgcattatccacaaatgagcaaagaagagcgtcgccaaaaagtgatgaaaaccttggaagaagttaatctttcgccatcaatgatcaaccgttatccccacgagttttcaggcggacaacgccaacggattgcgattgccagagcgattattcttgagccgaaattcgtcttacttgatgagccgacttcagcccttgaccgttcaacacaattgacggtggtggaattgctgaataatctccaacgtaaatatggcttaagttacatctttatcagccacgatttagcagtggtaagagcattgagtaacagagtgattgtgatgagcaaaggggaagtggtcgagcagggcgaagccaaacagatcttcgagcaaccaaaagatgaatacaccaagcggttaattgaagcgtcgaatttgtaaattagcaaggcatagtagaacaggggaatttatctttttctactatgccaagttttaggtaacggtattaacaaataccattcttaatattctcaagctcttcccaacgttcaaatgcttgctctaacgccatttcagcatccgccagtttttgtaactgagcttgagtatagctcggctctttagcaaagaaatccgcactattcacttcggcttgtaaggcttcaatttctgcttcaagctgttccattttttcaggtagggcttctaactctcgttgttctttataagaaagtttgaccttcttcccctctccctgcttgcgagaggaggtgtccgcaggacggagaggggcattttcgctttcaacaagcggtgctttttcaacatttttttgcaaagctccactaccctccccctgtttacggggggaggtgtccgaaggacggtagggggcttttgaggcaaaataattctcctgttgttgcttcgcatcgtgatagccaccaatatatttattcacaaccccttcgccttcaaagatgtagcattccgttgcggtattgtcgataaattgacggtcgtggctgacaataatcaaagtgccttgataatccgccaacatctcttccagtagctctagggtttctacatcaaggtcgttggtgggttcgtccaaaatcagtaggttatttggttttagcaataatttagctaataacaagcggttacgttcaccgcccgataaggctttgactggggtcatcgcccgttttggtggaaataagaaatcttgtaaataaccaagcacgtggcgttttaccccattgacttcaatatcttgtttgccgtccgccacgttatccattaccgttttttcaggatcaagctctgcacggtattgatcgaaatacgccacttctaacttagtgccacaacgcactgtccctgcggttggctgaatttcgccaagcaatagtttaattaaggtggttttaccaattccgtttgcaccgataaaagcaattttatcgccacgcaaaatggtagtgctgaagtttttcagcaaggttttacctgccacttcgtagctggcattttccacttcaaacacaattttgcctgaacgagcggtctgatcgagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtctgatcgagctgaatttttaccgtgccttgtacttctcgacgtgctttacgctcttctcgcaaggctttcaaggctcgcacacgcccttcattacgggtgcgacgagctttaatcccttgacggatccaaacttcttcttgggctaattttttatcaaacagctcattttgtaaggcttctacacgcagatcttcggctttggtttcaaggtaaacatcgtaattactaggataggaaaccagtttgccccgatctaaatcgacaatgcgagttgccattttgcgaataaaagcacggtcgtgagagatgaaaataatactgcctttaaactctaataacagattttctaaccaagcaatcgtgtccacatctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcgtgtccacatctaaatggttggtcggttcgtccaacagcaacacatcaggatccgccaccaacgcacgtgccaacgccgcacggcgaacccaaccgcccgacagctcgcacaatcgtttttctggatcaagctctaacagcttcaaggtatcttgaatacgattttcaaactgccaaccgttagcgtgttccagttgagcctgaacttgcgaaagttgcgacatcagcgtatcgctgtaatcggtcagcatttgttgcgaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgatattgctttaaaagatcggctaaatgagcgatcccttctgcgacataatcaaacacagtatcttcaatatgttggggcggatcttgttctaaacgggtgacaacaatatctttttcaaaaatcaatttgccatcgtctaactgaacttcgccagccagcactttcattaaggtcgatttgcctgccccgtttcgtccgacaagacagacacgttcgccctgttcaatatgtaattcggtgtgatcaagtagtggatgatcgccaaagcctaaataggcgttagaaaggttaattaaagccatagaatatctgttgaaataaaaatttcgcaaattttagcagttttcctaccgcttgtaagtgatttaataaagtgaagtaatgaaagtataaaagtggtttgagattgtattaaacttagtgagattgtactgatttgggaggtaatggaaagagaagctattactgcccataggtaatactgttctttttgtgtatgaagtttattacaaagtttgctacaatccatttccatcatagacacggaggcaaaatgcaagttgttacaaagctcatacctaccaaactgatttccagtaaatctacgcacaacgcacgttcagcaaatcaaaacattgaacgtagtgagcttttaaaaaaacttgccgatgttccacactaccctttaaccgtcgtgattgcccctgctggctacggcaaaacgacactaatttcccaatggaaagaacgcttattagcgaaaaatgaacaagtcgcttggtttgctttagatgaaagcgataataacgccgaacagttttgtcactacttttcatcagcattaaccaaagctacaggcatttcattacaagggatcacctataaaaataacttggtggattactttgggcaactcttaatcttacttgataatgttccccgtcgattttatatcattattgatgattaccatcttattgataatcccgaaatccacgatgcactgcgtttttggttgaaacatcagcctgatacgatgagccttgtgctactttctcgccttacaccgccattaagcattactaacttgcgtattcacgaaaaactgcttgaaattgatgtacatcagcttgcctttacacctgcagaaacccgtcaattttttgaacaaaagctaaatgaaacattaagtgacgaagtgatttttgcgttatgtgagcgtgtggaaggttgggcaacggcgttgcaactgatgatctttgccattaaacaaaatgcaaaactgttacatttccctgaaaaattactgaccaagctcaatcagcaacatattgctgactatcttaacgaagaagtttttcattatgtcgatcctgacatcaaacgctttatgcaacgttgtgcgattttacgttcaatgaatgaaaagttggttgtagctcttactcaagatgaaaatggggtcaagcggttagatgagctagaaaaattgggattgttcatcacacgaatgacccacgatgatgacgaaatctggtggaaatttcacccgattttagccgcctatctctcacaaagttgtcgcttggaattaccaaatgaatggcaacagctacaccaaactgccgcaatgatgtggctaaaacttggctatggctcagaagcactttaccacgcacaaatgctagacgatccacaaacgctctaccaaatactgcaagaacacggctgggcattattccatcaagggcaactcaaattattggaagactgtttaagccacttgccatcagaacagatatggcaaaatgaaaatcttgttctactcaaagcgtggttagcacaaagtcagcaccgtcaccaagaagtaagcggtattttgcaaaaattccaaccaaagttaccgcttactgagagtttgcaagggcgttttcacgcattaaaagcccaagtggcaatcaatgcaggggacgaagaacaagcctatttaattgccaaccaagccttagctaatttgtctgatgaatttgattatgcccaaattgttgcgaaatccgtgattggtgaagctcaacattgtcgtggttatctcaaagaaagtttagccttaatgcaacaagttgaaaaaatggcaaccagtcagcgagcgtatcaccactggctttggtctaaactacaacagtctgaaatcctatcggcacaaggcttttggcaatctgcctatgatttattaaaagaaactaccttacaaaccaaagaatttcatcaaattccgatgaatgaatttttgctacgcttaaaagggcaaattttatgggaatggcaccatcttgaccaagctgaagcaatggcaaatgctggtattgaagtgttagaaaaggaagaagaacgtattcaaagccttgccttattagccaaaatttccctaaccaaaggggatttaaacaacgcagaacgtctaattgagcagtgccgaatgttactggctcgttgttcgccccataaagattgggtaacggcacttgatgaaatccagctgatctattggcaaatgcgtaatgaaacccgctatttagaaggctggcttgctcaagcgaatttccttagccaagagcataaccactttacccaacgccaatggcgaaatatcgcccgttgttacctgctacaagaagattacgaacaagcattgcgtattctcaacagcttactgcgtaccacagcgatttttaatttagtgagcgacagccagcgtgcgttaattttgcgtaatcgagtttacaccttacaaggtaaacccgatttagcccaacgagatcttattcaagccctaaatttaagccaacagaccaactttatcagtgcgtttgtgattgaaggcgaaataatggcacaacaaatccgccaactactgcaactcaatgtattagaagaactttctacgcacaaagcccaatttattttgcggagtattaaccaacataaccgccataaaaccgcacattttgatgaagagtttgtcaaaaacttgcttgccaatccacaagtgccagaactgctcaaaatcagtccgcttactcaacgagaatggcaagtgttagggttaatttattcaggttacagcaacgaacagatctctcaagaactggttgttgcaatgaccaccattaaaacccatatacgcaatctctaccagaaaatcggcgtgtcaaatcgtgctgaggcgattgaatatactcgcagtttgttgcgaatgatggggtatatctagataaagtagaaaatcaacaatcaatttagaatctattcttcatatatatttctttttatttaagttgttttagtgtaaagtttggatgtatatgaatgtggatattattttatacaataatattttctattaatctaattaatgtttattggtaaatcactattataattttttcaaatgtgatttgatataagagagaaatataatggctaatttgtcccctgacgaagcaattgagcttgcatatgatatttttttagaaatggcttcagataatttagagcctgcagatattttactttttaatttgcaatttgaagaacgtggagcggtggaaatggttgaaactagtgaaaattgggagcaagaaatcggtgttttaattgatccagatgcttttgctgaagtttggattggtttgataaatcagaatgatgagatggatgatatttttgcacgttttttaatttccaatgatgctgagaatagagaatatcatgtaatttggaagagttagaggatgtaattgaggggacggagccaaggtaacattaatttattttagtctaatctttttaatccagatataataaaggcagcttttgagaagctgcctttatagtcattatttttcgatctcttgtggcaacgccaacaccgtttctacaggtttcgcttcgacattaacctctttcagatcttcttgttttaatctattcgctaattcgacatcgtgggtctgttctgcgacatacagtgccataatgcgatcttttgccacgcactctttatgctcaagcagttgcacaaagtaaggtttcgctttgtcgaaattccctgctctggtgtggatgtaacccaatactcgtgcgtaatcgtcactgtaacgttcttccgctttgctgttgcgttttaagagaactttgaatagtttatgctcttcatcaacttgtaagcgtgttagttccggatagagtaacgcaagctgttcatcttgatattttttcacggtttcaagggcaatttcttgagcagactgatgatcgtctgtgtcaattaagcgtttaatcaagccaacacgaacgtaaatagaacgacggcggcggcttggttggttatcccaccattttaataagccctcttgaccttcttcattcataatttcatctaataagccgtcattgacttgctgttcaagtctttcgtactcttctgccgataagaaactacgttgtccgatttgttctaatacgtcatcaagtgctttgtaagccttcgatttttggtagatttcaatcgctaggcgtaaggcttcaacgttgtttggtgcaagctctaataagctatcgactgcactgcgtgccgcagggagtttgccttgtagcagtaaaattcgtgtgcgggcaatttcaacggcaacgttgtttggccctgcgattttagcagcttcaattaaatacttgttcgcattgagttcatcgcctcgttgttgagcagcttcggcagctttgatgaagtttaacactggctcggcggcgtgttttgcattttttgcaattaatctctccgctttagagtaatccccttcggtcattttcattaagccttcgagggtttgctgttgtgcttttttacgtttgcgatcgccaaaccattgataagcacctcggcttaacccgaagaaacggcggaaaatccactctattgcataaaccaccgccattgccaccgcaaaaaagaccacgagcattacgaggctcatttcaatcactttgcctgcggtttcaatgcgtacataaccttgatgccccgaaatataaggccctaaaattaagcctgcaaggacaattagcattaaaaagagaacgcgaaacataatctatctcctattgttgctctgtagcaggttttgcttcggttggtgcttcttgagctggtgttgcttgctcaagggatttgtcttgttccaactgaattttgctaatcggtttaggagctttattgagcagttgatctaataaacctaaactgtgcagacgatttggtgcgtcaatgtagatagattgttcaatcatctcgtcaatttcttttaagaaggttttgacttgttcattttgcacatcaaagtaacttctcacccaagtgctaactgcctcaagcgattgtttatagagttcattttgctgacgtggaattgccaaaatcgcaatttgtaaacgcaagcggatattttctcgtaagtaaatctcttgatttggtgcaacaaaagctttctcttttgccgtcgctttatcgctgatacggataaagtgatttaagaaagagtttgcacttttttctaggttttgttgccagtcttgcactgagttactcacttcgccggtggcaacactttcttcttccaccgtgttgtcgatcatcggcatatcatcaagcaaattcgctaattgcgttaatcgttgcattaaattattttgatcaacattgtttacactagcaagttggctgaggtcttgtttaatcgcttcacgaatgttaagaactcgattatcgctcacttggcttaatacgttatccgcttcaataagcaagctacgagctgtatcaatatcgttatctaacactactttgcgtaaggcattgttaagtaagaaatcagcgtcagataatagccattcactttggtctgcttttggtgtcgcccctaatttttgaatttggctttgtagggcgttgatttgctgagtataagccgtttgtgcattctctaactgtgcaattttatctaatgattgttgataatcttgagtaagtttggcaattttgactttttcttcatcaaagttagggatttcagcaactgtttgttcggggtgattttgggttgcttttgcttgtaatgcttgaatttgtgtatcaagttgagcaaatttttggttgccgaagaaataccctgttgcccccacgcctaaggcaatcaagatagccagcagagagagtgcttttccccctgatgattgttttggttgttctgattgaataggttgagcaatttccacttgtttttcctcttcttcagtttttggatcaatagcggtgacttcctctgtctcttttaccatttctggctcagagactaccgcttgttctacatcgactttcacatcttcagtcacgactggctcaaggttttctgcaacgttttctgttgcttcaaccgcttttggctttttgctctgtttcgacataatgttcacctatttagttaaaatttcccacagttgagtattgtttccagcagactatgattatccgctttcattgaaatttgaatttgttcgcttttccagcctgattttcgggcaagtgtggcgatacgtttgccaaccacaattaaacgacattggtagagccaaggcagatccgcttctgcggtctgttcgataaacgtggttaaaatctcaccgcttgtcacgacaatggtatctgttcctgctcgttttgcgaggcttatctgttcgcttaaattatccgccaacattatacggcgataacattcgaggatctgcacttcagcacctcgtgaagttgcctgttcagcaaaaaattctcgccctgtatctgcgcgtaaaatcagcacattttttccagacaactgagccatttcaggcagtgccagtagcccttcactgttttctgattgaatagggtaacgtaccgcttgttcaatttgggaagcgaaatggtttgccgaacgttgtccaacggcaaaatagagtaaatcacttcgccagtgaaatcccgtttgctttaaggtttcagttgcaaaatcaacggcattttttgacacggcaaaaacataatcacccgaatttaaacgagataaactgcttggcaaagtcggtaaatccgcccctgcttcaactcgaaacagcggttgatgaatggcaaaaatttgctgttctgccaacatttcaactaattgttgccctcgttgatcgggacgtgtaactaaaacattcatactattcgctttgataaacggtttttaaaatgtgatcagccccttttgcaagtaacgcttctgccacttcaacacctaatttctctgcctcttttatgttgccttttgctgacgctcttacaatggttgaaccgtctaacgaaccgacgagggcatttaattcaatttcatcacctgttaatgttgcaaaaccgccgataggcacttggcaaccgccttgtaaacggctgttcattgctcgctctgcttgtacacagtaagcggtcggttggtgatttaattctgcaagataggctaacactcgctcgtcattcaaacgggtttcaatcccaactgccccttgcccacaggctggcagtgatgtttctacagggataaaggtgcggatacgttcgcttaagcctaagcggattaagcctgctgaagctaaaataatcgcatcatattcaccattatctaatttgctcaggcgagttccgacgttgcctcgtaaggatttgatctgtaaatgcggatattttgccattagctgacattgacggcgtaggcttgatgtccccacaacagcccctgctggtaaggcttcaaggtttgcatagtgattagatacaaacgcatctcttggatcttcacgctcacaaatgaccgcaagccctagcccttcaggaaaagtcatcggtacatctttcattgaatggacggcaatatctgctcggttttcgagtaaggctaactctaactctttgacaaataatccctttccaccgatttttgctaacggtgtatctaaaatgatgtcgccttttgttaccattgtaaccagctcgactgataattgtggaaaacgctgttctaatgcgtctttaacgaaatttgcctgccaaagtgctaggggactttgacgagtagcaatgcgtaaaatctctttcattcgtttacttttctttaaataaagatagccgttatcctaccactatttggcctttcttgccaaaaaaattgaacagtgatcttgacgacaataaaagaaacattaaaattcgcaacgctttaaaaaagcagttcggatgaagatagctggagagtggggaataaccctacaccgacgaggtaaaatctttcaggtgcgacagcgaggacagctattggacgaacccttggagagatccactctgcatagcagaaaatggacgccgaaggcgaaagcaatgaatgcgaaacgctcaggcaaaaggacaggggagaaaagtaaccatcatttcaagcggtgggattatatttattgcttttgtgtcaggtatccttgaaacacgcaaaaaattcatcacatcattccgcttgtcttattgcttttctttccttgtaagttatttttacgaggaattatttatgtcaattgacaccattcttagctcaataaatagtatcgtttggggaccaccactgttgttattagtttcaggtgtggggatctacttcacccttaaacttaaattactgcaatttttccacttacctcgagccttttcttatatgttcaaatcagaaaaaggcgataatcaatcaggggatatttctgctttaggtgcattagccactgcacttgccgccactatcggcacaggtaatatcgtcggggtcgccaccgctattcaagcaggggggcctggggcggtattttggatgtggatcattgccctgtttggtatggcaactaaatatgccgaatgtttattggcggtgaaattcagaggcaaagataaagacggctatattgctggcgggccgatgtactatatcgaaatgggtatgggacaaaaatggaaatggctggcaaaactgtttgcgatatttggggtaatggtcgctctctttggtattggcactttccctcaagtcaatggaattaccacatcattgcaagatacgttcaacattccgattagcattaccgccgttatcttaacgcttaccgttgcggcaattacgctcggcggtgtaaaacgtatctcaaaaatttcaatggtgatcgtgccttttatggcggttagctatgttggggcttccctgctgattttagtgcttcacgccgataaggtgccagacaccattgtctttatcgtaaaagcagcttttaaccccgaagctgcattaggcggtgtaattggctttactgtcttacaagctattcaagctggggttgctcgtgggattttctctaacgagtcgggcttaggctctgcacctattgccgcagcggctgcacatactaaagagcctgttcgtcaagggttgatctcaatgactggcacattccttgataccattattgtctgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatgacaggcttagtgattgtattaactggggtatggacaggtccaacacaaggggcagttttaactaacttagccttctcagaaggtttagcaagctctatcggagcaatgattgtcaccatcagccttgtattttttgcattcaccacaattttaggctggtgttactacggcgaacgttgtttagtctatctgacaggcggacgcaccaaaaggattaaactctaccgcttgatcttcattatgctgattgccgtggcaccatttatcaaactcaatacgatttggacaattgcagatattgtaaacggcttaatggcattccctaacttagtcgctttgatcggcttacgccacattgtgattgaagaaaccagaagttattttgagagattgaagaaggggttggtggagtagttatgatagattttaaatatctataggaatttaaagtcttatgtgaaacgggctgtattaagggaatacagcccgtttattataatctaatcaattagtttacgcttttgcctgcgtgcgtttacctaaaatcaccgtcaccacaaacgcaatacttgctgaaattgccataccaacactgtacattgcaaggctttcaggtttaattgatggaatacctggtaaacctgccgcacctaatgcgattgcttttacattgaatagtgcgataaatgcacttgatgtacccgctgcaatcattgctgcgataaatggataacggtaacgtaagttcacaccgaacattgctggctctgtgatacctaataatgctgagatacctgatggaacagccataccacgcactttcgcatctttcatcacgaatgcggcacctaaacacgctgcaccttgagcaatgttagacattgcagcgatagggaagataaatgtaccgccagtgttcgccacttctgctaataattgtgtttctaccgcaataaaggtttggtgcatacctgtgataacgattggtgcgtagaatgtaccgaagatcgcaccgcctacaaagcctaagctatcgtataaccaagttaaacctgcagagattaatgaacctgcttcacgacctaatggaccaatgatagtgaacgctaagaaacctgcaatgaataatgagaataatggcgtgattaagttatccaagaatgaaggaacaactttgcggaagcctttctctaaagttgctaatacccacgcagaaactaaagtagggataacagtaccttgataacctactttctcaatttctaaaccaagtacattccagtactggattttgccatttgcaagggttaatgcatagttccaaccgtctgctaatgcagggtgaactaataacataccaagtgcagcccctaagaatgggttaccgccgaatttacgggttgcagagaaacctaaaagaactggcaagaacacgaatggtgcatttgcgaaagtgttcattaagtccactaaatccgcaatacctgggtacatatcaacaacattcaaaccttctgcaaagaagccttttgcagtaagcattgagtgaatacccattaacaaaccgccagcgacgatagccggaatgataggtacgaaaatatccgctaaaccttttacaacgctttgtaagaaaccttgtttgtcagcaccagtactagcaacttcagatgttgtcatatcgccaatacctaagattttcgtcaattcagcgtgaactttatttactgtgccagaaccaaaaataatttggtattgacctgcaaccgagaactgacctttaacgccttcaatgttctcaatgccttctttatcgattaaagtttcatctttaaccaccatacgcaaacgggttgcacagtgtgctgcagcagagatgttatctttgcccccgagtttatcaatcacttgttgagcgatttgaggaaagttcatagttaccacctattttttgtgtatagaaatactaaaaattaaacagtggtattttaactaaaacggtttagctaagaaagtaaattttgctaaaacgttttagttttgtaatctagatcacatttttagcaagtttagctattatgagaataatgcgtctgatagcatatgaaggatttgttataattgaacattctcagtgttacaaattagagagaacaaatatattttttaggaaatatggaacttatttttaaaatgcttctctaatttatgcagaagttaattctattttcttatagaacaggagaaacaatgaaaaaatcattattaagttacagtttatcgttaatcttaggcttaggagcgatggcttccttgcctgtttttgcaaattctgcaacccaacctaccgctatcacaaatactcaacagcagttaggctttgaactaatcaaaacaaccatcaataaaagcccaacggataaagctatctatcaaggtattcgccttgcgaatggaatggacgtgttactgatttcagatgacaaagcaaataaatcgctaatgtctgtcggcttgcctgtcggttcaatggacgacccagttaagcaacaaggtttggctcactatttagaacatatgattttgatggggtcaaaagccttccctgaaaccaacagcttagatggctttttaacgaaaaacgggggctacaataatgcctttactgcgtcagatcgtaccgtttattatcttgaagtaaataacaacgcctttgatgaagcggtggctcgccttgccgatgcttttgctcaaccgttgttatctgagacgaatgctaaaaaagaagtgaatgcggttaatgcggagatggtgcgagcaaaatccaacgatggctttttaatgcacgatgttaatcttgctaccgctaacccgaaccacccgattaccaagtttgccgttgggaataaggtcacgctatctgataaagctgatagtaagctacaagatgaattagtgaaattttatcaacaatactattccgcaaacttaatgaaagcggtgctttattctaatcaaccgattgaaaaactggcaaaacttgcagaacagaccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcaaggttgagaataaaaaactcacagccccgacggtggatatgccatttttccgtgcggaagataaagcggtgatgatccattataaaccggtgaaaccaagcaagatgttggcgatttcctttgatatgcctgaagataaagctcagtttaagcataaaacaggggcgtatctcgcttatgtgttcaataataataccgatggcacactgtctgattatttgattaagcaaggactgtctgacagcggtgttcaatcggtagcgaatcatgatgttagtcgcaaccgtggtgattttaccttttatattgaattgactgacaaaggcttagcagaacaagacaaaattatctcgttggttttccagcaaattgaagcggtcaaaaaagcaggtattcaacagagctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgatgaattaaaagagagcttaagccaagagtttcaacatctgcagacggaaaaaagtggcaaactatgagttatccgctcgaaaatatcatcgaccagccttatgctattgaacaaatggatacgcaagcgatcaatgcaaaacttgctgagatgacattagctaacgtgcgtattttgctcgttgatgataaagcgaaaaccgataaaaaaaccaaatattttgaagccccttatgccgtacataaaatcagtgagcaacaaaaggcaaaatggcttgattttagccaaaatcctgagcttaaattgccagcgttgaacccgtatttcgcaacggatttcagcctaaatgaaagtgataaatctcgcttaaaaccgcaactgattgaagcagagcaaggcacgcaaatctatgcaatgccaagccattattttgctaacgaaccgaaagcgaaaatctcgttagtgctaggcattacgccaaaagtggaagatcttaaacaagccgtcagtgcagtgttgctgggctatatgggcgatttagtccaaagcaaaattgatttccaagcctctattgcaggaatgagtgcgagtgtatcaatggcagaaaatggcgttgtattacaagcggatggttacacccaaaatttagcaaaattgctgaaagataaaatggtgttattccaacaatttacgttaagtgaagataccctagctcaagcaaaacagcgttatcttgaagccttagatcgtgcagaaaaagagaatgctttacgccaagcaaatgaggtaattactcgtttctccagttatccctattttgaaatggcaaaacaacgagcaatgatcgagcaggtcagcttggcggatattcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgcaacgccgaaagatggcccaagtgcaggtattgcaatgtgtactgcattaatctctagcttaacgggcaatccagtgcgtgcagatgtggcaatgacaggtgaaattactttgcgtggtaaagtcttgccaatcggtggcttaaaagagaaattgttggcagcacatcgtggtggtattaagacagtgattattccaaaagagaatgaaaaagacttggaagaaatccctgaaaatgcaaaacaagccttagaaattcacgctgttgaaaccattgatgaagtactggcgattgcgttgcaaaatccacctgaaggggttgagattgtgtcaaaatctattccaccaattaaagtgaagaaaacaaagactcgtccggctatgcaataaatagttgatattagctaaggtgactatgcctcattatttagagtgtaatagacaaattttctgctaaaaatggtttaaagccttgtactatacggtattataggctttaagccgttttttagccgtcattttgtaaactatgccaaacaatttcaaaattagaaaatcgctctacgcaaaatttgaatttctactatctaaataatcttatttactaaaaacgtcaaaacttcataatgtgccgtatggggaaacatatcgaatagttggacttttttgagttcataatggctgaatgaggcaaaatcttttgccattgtttctgcattacaactggaataaatcaagtagggtgagccgagttgattgataaattcggctaacggtttgcctattccccgccttggtggattgacgatcacgagatcgggcgttgttccttgttcattcaaggcaaattgagccgagtccaatgaggcgaatttgacattttgtaagccaagttgttgggcggattttgtggcactggcgatggcagaggcagaaatttcaatgccagtgagtgcgacatttggattgttggtttgtaatgtgttagcacaatgtagcccaaagcccccgacaccgcagaacagatcccaaagttgtgtaatcggnnnnncttttatccattcttgagccgtgtgataaagttggctggcgaccgttggattggtttggaaaaaaccttgcggacgaataaacagcggaatttggttaaaacgctcttctaatacttgctgttccgtcagaaaaatctcttgttcaccttccaaaatcgcagaatgttgcggttgtatattcaaactcaccaccgatttttcaggcagttgagccagtaacattggcaattcacgctcgacaagcggtcgttttagctcacttcttagcacaaagcggatcatcacagattgattatactgactttgggtaatcaagatatatttgagttcgccccgtttttttgccacgttgtaaggcacaagcccagcccgtccgataaagtttttcagaatagggaaaagtggtgtaaaggcttgcggatagagcggacagtccgttaaatccgtgcctgtgccgtcgtcgtttaaaatgcctaaaatcggacgctcaacgcttcctgtgaccaccattttggctttattacgaaaatgtgccaaaggcgatgtgaccacaggtaaaaattccgtgctttgcaaaagataaggcgaaactaaccgcttaagatcggcagttttctctactagttgttcggcatagcttttatgaagccattggcacgaattgcaacggttttgttcaaaatggtggcagttgagtttaggcattctgggctttccattccaaccattgatcttgaagtgtagcaagttgttgatgagcctgttgccaacgtgggctggcggttaattccgaccagctaatttgcttccgtttcattaggcttaagtggcactctttctgtgttggggtaggttgatatttcaaattatctaacacttgcaccacgccgtcaggctcgttgcagagtagtaataaatcacaacctgcttgtaaggctttctcgcttcgttctacatagttccccataaaaccagcccctttcattcctaaatcatcagagaagatcacgccattaaattgtaactgtttgcgtaaaatctcttttagccagtaacttgaaccactagcaggttggctgtcacattgggtgtaaataacgtgagcaggcataatcgccgataattttcctttggcgatcagctgtttaaacggctgaatgtcgtgattgaagatcgtttcttttgggcgatcatcaaagggcgtttcaagatgagagtcagcaataacgtgaccgtgacctgggaaatgtttgcctgtggttgccataccgatttctcgcataccgtcaataaaggcttcagcgacaggtagcattgtggctacatcttccccaaacgagcgatcgccgattgccttgctacaatgcccgagatccaacacaggggcaaaacttaaatcaatatctaatgcaaacatttctgcggacattagccagccagcttcttgggctagttgcaagcggcctaattgtaaaaaagattgcattgcaggcaatttggtaaatccttcacggaaacgttgcactcgaccgccttcttgatcgacggtgattaataatggctttttcactcgttggcggacagatttaactagagcttgtaattgggttttatcgtgaaaattgcgtgtaaagagaataagtcctgaaaccagtgggtgttcgagtaactcttgttcttcttgagtaagttcgtagccagcaagatcgataagtagcatgataaacctttgtaaaaattattatttttcttttaagaaagtcagtacttttgccaaatcccttgtccgtttcgacggcggtaggcttttcaaaaaagttgagccatattgtcgcattacaagacgagagtcacagataatcaccgcccccctgtccgttacatcgcggatcaaacgccccacaccttgttttaaggtaatcaccgcctcgggaatttgaatatcattaaacggatcgccaccttgcaacttacaatcttccattcgagctttcagcaatggttcatcgggtgcggtaaaaggcaatttgtcgataatcaccaacgacaacgcatcgccccgtacatcaatcccttcccagaaactttgcgttgcaaccagtacactatttggctctgcaacaaacttctcaagcaggcgacttttactggtttccccttgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgctcaacgaactctgttctcgcaagaaatccgctaaaccacgcatcataaaataggacgtacaaagtaaaaaacaacgcccattattcgcttcaatcacaggtttgagcaactgccccaattctgtcaatgtatgggatttattcgtatcaggcagataacgtggcacacagagcaacgattgatgagcataatcaaacgggctttgcaacaccatctgttctgcattctcaatccctagtcgctggcagaaatggtcgaactttccgccgacttcaagggttgctgaggtaaaaatccaaccaacttgatttgctctcatctgctcaccgaatttatcggcgaccgtcagtggcgtaatgtgcaagccgaaggaacgcccattgatttcataccaataacaatagccgacaacactagtatcgcccaatctttttaactgtgctttgacttcagccaaacgttcaaagattttatccaaggtttctgaacgaccgagcgattttttcaccacttcgcttaaaaaatcaatgttctcattcagcttagcaaagccttcgaccactttcggatcttgcaaaatttcacgcaaattcccccgcttgttaccgtcccctagcaacaagcggaaatcctgcaccactttttgtagatgatcggacgctttacccaactgagcaagatctttcaactctgtacgataaacaatgttactgtctttgcaaatatcaaataattgacgagatgtcagcgattgcccaaagtactggctagcaatatcgggcaactgatgtgcttcatcaaaaataatcagctctgcatcagggattaactcaccaaagcctgtttctttcacagccatatcggcacaaaataggtgatggttcaccacaaccacatcagcttccaacgccttgcgtcgagcttgtaccacatagcactctttataattcgggcaatccgatcccaaacagctttctgctgtcgaaactaattgcggtaaaatcggactatcttcggcaatggtgatacattcgctcaaatcccctgtttttgttcccgtgtgccatttccgcaccttcgccaaatccgccaacaccgatttatcgccaaccacgcccattgcgatcacctgatctaaccgctctaaacagagataattagcacgcccttttaataacgccacttttcccttatatttcaaggctttttgaatggttggcaaatcacgattaaacaactgatcctgcagatttttggaacccgtagaaatgatcgtttttttgcccgatagcaacgctggcacaagataagcaaaagtttttcccgttcccgtccctgcttcaatcaccgcacttttggcaaatttcacggctcttccaaccgcttgtgccatttctaactgagcatctcgcggacgaaaaccgtgaatgttttggcttaacgtgccttcggggctaaaagcgtcggtgattttttcggatagtttcatttgaataagtaacgtaaagaatcttacatccatgtaagagatttaacgatagctgaagaatggaaaatacatcaataatctgtactcagaatattaaattaacactattttgtaccaaaaatcttatcgccagcgtcgcctaagcctgggataatatagccgttttcatttaaatggctatcaattgcagcggtatagagttcaatatcagggtgagcttcttcaagtgctttaataccttcaggtgcggcaacaagcactaacactttgatttgtttacagcctgcagcctttaaaagatcaagggtagcaatcatcgatccacctgttgctaacatcggatcaaccacaatcgctaaacgttcacctacatcgttagctaattttttgaaataaggcacaggctctaaggtttcttcgttacgatagatacccacaacgctaattctcgcacttggaatatgctcaagtacgccgtccatcatacctaaacctgcacgaaggataggcacaacggtcacttttttacctttaattcgttcaatttcaactggaccattccaaccttcaatggtaactacttccgtttccaaatctgaggtcgcttcgtaagttaaaaggctaccaacttccgttgctaaggcacggaaatctttagtgcttacatcagcggcacgcattaaaccaattttatgtttaataagcgggtgttttacttcaacaattttcatttttggtctccggttatgtttaaaaaaaatcggactattctagcagaatttaacaaagaaagtttaatctagatcagataaaagttcccaaaatgcacgaatgatcggttcttgcaaacgacgttgctgaacgcaaacgcctaactcaaatgcatcaatcggagtttctaattgaatatgggaaatctggtttgccacagggctttgttgaacaacaacatcggggatcatcgcaacaccacagcccaaggcaaccatcggcacaatcgcttcgtgtccttccactgtcgcataaattttaggctctttaattttttgcaatttaaaccaatgttctatccgcttgcgagcaggcccatcaacgggcaagataaaaggcatattctgccaatcaatcggcgttttctgtaacaattgcgttgcagtacaagcaatacgcggggcaactaacgataattgaatatcatcaatatagtgaaaaataatgttattgggtaagttttcaggcttccctgcaagagaaatatccgactgcaacgattgaacgctatacagcgctttagcaggatcgcctgtactcaatttgatctcaatcttaggatagcgttttctaaattttgctaaaatgcgtggtaagtggctgtaagaagctgttacagagcagaaaagtttaagctcgccttccaattcagtttgatttggcgaaaaatgtcgttgaatttgttgccattccgcccaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgatgatactatcgcccgtgtaataaaacgcattgagccacaagcatttaatgaggtttttcttaattttatcaatgagatacgcacacaacaaggacgtgaagtgattgcgattgatggcaagacacttcgtcatagtttcaatccrgaaacccaaagtgctttgcacagtgtgacggtgtggagccagtctcgtggtttgattttatcgcagaaaaaatcctcgggtaagcaaaatgagcagcaggcggtgatggaaattatcgatagtttttgcttaaaaaatgccgttataacggtggatgcgatgaatacacagaagaaaattgccgagaaaatcatcgaaaagaaaggggattatgtgatgccgttgaagaaaaatcaccgtcaatttcrgtcggaagtggaggcgtattttcacaaaatccgccgagattgccccgaaatgcttgagacgtwtgaggaggtaaatgcggaacgtagtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttaaaagatcaacacgctctacttactctgctataatgtcccacttttattacaagcggtacaatttcatggaaaatttgcaagaacaacctgactggaaaccatcagcctctattcaacacttattgaaacgagcaaaaattatggcggagatccgtcaattttttacggaacgtggggtattggaagttgaaacgcctgcgatgagtgagttttccgtgacggatgtacatctttcaacctttagtactcaattcttgtcgccgttttcaagccaagcgaaaaccttacacttgattactagccctgaataccatatgaaacgcttgcttgcctgcggtagtggggcgatttttcagctctgccgagtgtttcgcaatgaagaagtcagtaaacaccataaccctgaatttacgatgttggaatggtatcgtccccattttgatatgtaccgtttgattaatgaagtggacgatctgttacaacagattttagactgtgaacctgcggaatcctttagttatcaatttgtatttcaaacctacgttggcttagatccactctctgccactaaagctcagctggtggctaaagcgcgtgaacacggcttgcaatgtgatgaagatgaacagcgtgatactttactgcaatttttatttagcgaagtggtcgaagcgaatattggcaaagagcgtccaacggctgtttatcacttccctgcaactcaagcggcacttgctcaaatcagtacggaagatcaccgtgtggctgaacgctttgagttttattacaaagggttagaacttgctaacggcttccatgaactcagtgatgctaaagagcaaattcgccgttttgaacaagataatgtgttgcgtgaagcgatgggtttaccgccacagcaattagaccgtcgtttccttgaggcgttaaaagcaggtatgccaaactgctcgggcgtcgccttgggggtggatcgtttaatgatgattgcgatgaatgctgacagtatcgatcaagtgatagcatttggggtggaaagggcgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataacaaaggaacaaccttgaacaatttatttattattgactcacactgtcacttagactcgctagactatgaaactcgccataaaaatgtggacgaagtgatcgacaatgccaaagcacgtggcgtgcaacagatgatctcgatttgtacgacgcttggtcgctttgaagcgatgaagcgacttacagctcatcgtagcgaagtggccctctcttgtggtgttcatccgttgaacgtggaagatgaaccgtttgactatgataaactggtggcattggtgcaagatcctagagttgttgctgtgggggaaacggggttagattatcactacacgcccgaaaccaaagctctccaacaatcgttgtttgagcaacatatcgaggtagcaaaacaagtgcagaaaccgttagtgatccatacccgttctgcccgtgaagacacaatgcagtttttagaacaagggaatgccgagcagtgtggcggtgtgttacactgctttacagaagactgggcaatggcaaagcgtgcattggatattggtttttatatttcgatttcagggattattactttccgtaatgcggaagaattgcgagatgtggtgcggaaagtaccgcttgatcgtctgttagttgaaaccgactctccgtatctcgccccgatcccttatcgtggtaaacctaatcagccagcttatgttcgagaagtctgtgaatatgtcgcaacactaaaaggcgtatctttagaagaatttgctaacattaccacgcaaaacgtgcgaaaattgtttaaaatttaatggctatattaatgccgaactttcggataaggattttttatgagagcaatgtttaaatactttctgatcttagtgtcactctcactacacatcgtattagttggtggggtaaattatgcatttcctagctatgagcaaacaatggtcacaggaatggaagtgcgtcgtatggataaagatggggtaatcagcaaatcaaatccagccgatggcgaagtgcgtgacgtgtattttcttttcaccgaacaccctgataccaaagcggtaatggtttaccgtaatgaagataccagctggggattaccgctttacttcaaatttggctctgccgatattcaagcaaaagcacaagcctatgcgaacgaaaaacagatggtacaaattaagtactacggctggcgaattaattggttgaatgaatttagaaatatcgtgtcaatcacaccgcttgcggaaggtgagactgtgtcaaaaccgtgggtaagctatattttatatgctttctttgcattgactttctttttgtctgtgcagtttattcgtgggtggtttgatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatgactacctactttatcgccgatcttcatctcaacgacaatcaacccgaattgacggatctgtttttgcaatttatgacagaaaaagcaccgcttgctgaagcagtgtatatcttaggggatctgtttgatttctggattggtgacgatgagcaatcgcctttgattgatacagtgaaacacgctattcgtcagctcacggatcagggtgttccgtgctattttattcacggcaatcgtgactttctaattggtaaagattttgctaaagccacaggaatgatcttattacccgattatcaactgattgatttatatggtaaaaaaaccttaatttgtcacggtgataccctttgtattgatgatattaaatatcaacaattccgccaaaaagtccatcaaaaatggcgacaatggctatttctctgcttaccgctcaaactgcgtattcatatcgctcagaaaattcgagccaaaagccgtgcagataaacaacaaaagtcggctgaaattatggacgttaatcctgaatttaccgctcaaattgtggataactatcaagccgaatggcttattcacggacatactcacaggcaagcggtgcattttgrcmaaaattttgcaaaatctgaccgcttatttactcgcatagtccttggcgactggggaaaaactgcatctattttatctgtatcacctcaaggttttgcttttaatgaggaacgttaaatgatcgatgtgattatcccgtgctataacgcagaacagacccttcaacgagcagtacaaagtgtgcttaaccaagctggattaggcacattatggatcattgatgatgcttctaccgataacacctttgctcttgccaaacagtttgaagcacaagttccacataagattagagttgaacagattcctcgaaatagtggtgttgcaaaggctcgaaattgggggcgttacaaagtgatacagaggttatcgcttttcttgatgccgatgatgcttatgaaaatggggcattgcaagttgccgaagcaattttccatttccgtcctgaagcaatggtagttcgccgtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtctttcgccgtgcattcctccttgcttgtggcggttttccacaatatcaactatttagggaactgggcagtgaagatggtgctttaggcattgcaacgaccaaaatcagctatgtcgcaacggcatttactgaagcgggcgtattacattactgccgtgacggtatgcacgcagaacgtttgcttgacgcagttctctttaataaacaccctgaaaatgtaacggaagagaaaatggctcaagccaatgcggtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatggctcaagccaatgcggtgacagacaatatttgccaacaaatcaccgcattagtccaccatcttaagcaagaacaggcaggaatatatccgcttgtgttaactcgtgaagatattgcttagattgaagttaggtcattgctctaactgccttgacaaccccaacaaggtggctgagtttagttaaaatctcggtaagatgtgttttgtctttcacactgaccaataatttcacttgatacacgccaccttctcgctgttggctgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatatcaaggatattgctgttcattttggcaatcgcagaagtaatcccagctagaatgccttgttgattgagaatatcaaccacgatttctgcttcaaattcaacggatttatctttagcaatttcccagcttaccggcatatagtgacggtgatccgtcgcagcttctttcacattgcggcacgttaagcagtgaaccattaaccctttgcccgaactgatatgcgcaataatttcatcaccagggacaggtaaacagcatttcgcaaagctaatcaaaccgctatctaccccttggattgcaagagattgattattttcaggattaccgtctgtatcaatctctaaggtcttactagataagcgttgagcaatcactccactaatttgattacccaaaccgatttcggctaataggtcatcaaaattggataattgtagatctgttagcaatgcctcaattacaacgggatcaagatgttcaaaattagaggtattaagtgagagcaataattgtcgtctcccaagagaaattgcctgtgtacgctgctggttttttaaggtgttacgaatacaagagcgtgcttttgccgtgaccacaaagttcagccacaatgcatttaaccttggactttctgccgtttgaatttcaatggtttgccctgattgtaacggctgagaaagtggatacggctgatgatcgaccactgcaccaatacagcggtcgcccacatcagtatgtaccgcataggcaaaatccacagcagtcgcattggctggaagctgtacgatacgacctttcggagtaaagacataaatgtcgcttgaaaacagatcagatttaacgttttcgataaactctgccgaatttcctacattttgttgcatttccacaatactttttagccattgttgcgtcctgacttgaacactcatattagcttgttcttgatagccccaatatgcagcaacaccaaaacgagctgcttgatccatctcttcagtgcgaattaatacatcaacaggcacacctttaggaccaatcattgaagtatgtaaagattgatagccatttgttttaggaaccgcaatatagtcttttagttggaaaggacgaggtttatatagactatgcatctgccctaatactcgatagcaattatccacactatctacaacaactcggaaagaataaatatccaaaatagaattaaaacgttgtactttttgcagcatacgtccataaagataatagagatggcgttccttaccatacacacgggctttaatccctacttcatcaaggcgaatttgaatttcctttgaaatttgttcaatcagccctcgacggcttcctctagccatatcgactgctgcttttaacaccttataacgataaggatacattgcttctaaacagagatcttccaattcatttttgatatgttcaatgcctaaacggtgagccaacggcgtatagatttcaatggtttctttcgcaatacgttggcgtttatctggacgcaatgccccaagggtttgcatattgtgggtacggtcagccagtttaatcaatacaactcgcacatctttggtcatcgccaagatcatttttcggaagttttctacctgtgcttcttggcgagtacggaactttaatttatccagttttgatacaccttgcacaatttctgcggtgcttgtgccaaactctgcggcaagctgttcttcggtgtaaggtgtatcttcaattacatcgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcgccacttgaacggaattgcccctcgtgtgcatcacgagccacaacaaatgcccgcttcacaatatcaatttgatccgcaggtaaataaccttgaataatggtattaagactttcaaataactgcactttacacctcacacaacaaaaactgagatttcgtaatgtataacgaaaaatggacaatgaaaagggcaaattacccttttgattgtccatttttaacaaaatttgatctaattatgaatttgcttgcacatcagccaagaatgaaatagcttctttctctgccacttcttgtgcgattacatcaaatttctcttgttgatccataatttgattattaatcaaaccttcttcaatttcacgcaatgcgataactgttggtttatcgccctcttcagccacaagcggctcacgagtgtgaagttgaagctgtcttgcacggcgtgctgccgttaaaatcaaatcaaagcggttaccaattttctctactgcatcttgaacggttacacgagccattgtttactccaaattttgcaaaatcctgaacttgtaaaagggtgaagattatacagaagttgtataaggctggcaatgatagagagggaaatctttatagagataatagctctatttgtaaataattttgctgtagttaaattttgtaaaagatataaactcatatagcctattttatctctcctcgctgttttctcattttagtgtatcttaggttatcggttttcattggaacgaaaattgtaggaatatcattgctccactattttcctctatcagataattggagagaaccatatttgtcatatcgaatcaaataaaagccccgattatatttcggggctgttaatctaaagaataattagaacttcgctaaaagcattgcttctaatttctcttggtcaatcgcaaatttacggataccttccgctaatttctcaactgccattggatcttggttatgttcccaatagaattcagcttctgtcattggtgctggacgagctttcacttcacctttgtactctaacttacgcactaacggtgcttcgctttcttgtaactcttttaatagtgctggtgcaattgtcaagcggtcgcaacctgctaattctgtgatttcacctgcgttacggaaacttgcccccatcaccacagtgttatagccgtgttgtttgtagtagttatagattgaagtcactgaaaccacacctggatcttctgctggtgcatactctttcttatcagaatttgctttgtaccagtcaagaatacgacctacgaatggcgaaattaagtaaacgccagcttctgcacaagcacgtgcttgagcctgagagaataatagcgttaagttacagttaattccttctttttctaattgctctgccgctttgataccctgccaagttgaagcaattttaattaagatacggtcgttgctgatccctgcttcgttatataacgcaatcagtttgcgagctttcgcgatagttttttccgtatcgtaagagtagcgagcatcgacttctgttgaaatacgacctttcaccacttttaaaatttctaaaccgatatttaccgctaatttatcttctgcatcgatcagttgttgtgccttatcattgcttttagcttttgcataagcaatcgcttcatcaattaatggagcatattgaggtagtgcagatgcacttaaaactaatgatgggtttgttgttgcatcttctggttgatacgctttgattgcatcaatatcaccagtatccgcaactacgacagtcatttgacgtaaagcatctagttggttcataaaaagttcctctataatataaaaaacaccgcctgtaataataacagtaactgcttaaagcacctagtatgaattaagtaacgagattatattttacaatatgttaactgggtactatttcttttcattccaaggtgctacccaaaacaagcataacattcctggaatcgctaagaaaaagcagatccaatagaaatggtagaagccaacgctctcagctaatgccccagatgtcgcaccaatcaatttacttggaatcgcggttaagctggtgaaaatcgcaaattgtgttgctgtataaagtggatttgtttcacgagaaatataggcgacaaaacaggctgtgcctaagccaattccgatatattcaccaataataaccgcagataaagcgaagcgttcgtaagtaccgattgtttcaaacttaccgtgacttgcaagccacgcaaagccgagtaacattagcatttggaacacaccgaaaatccataaagagcgatttacgccaatacgcaacatcagcacgccacccaccatgcccgccacaatagaagcccatagtccgttgatttttaccgctgtacctaaatcggtgcggctaaagcccatatccagaataaaggcactttgtaaggtagccgcaaaggagtcgcctaagttataaagcaatataaaagtgagtgtgccaaccgccggccataaacctttacgttgaaagaactctttgaatggaataacaaaggcttcgtggaaaggaagattgcggttatcttgtaaaattgttggctctttcgctaagaataaactcagaataatcccagggatcataaagagtgcggtaaacaaaaagactgtttcccaaggatagtggtcagaaacaatcaacgctaacccacctggaattaacccagcaatacgatagccgttgatatgaatggagttacctaaacccagttcttcatcagacaaaatttcacggcgataagcatcaaccacaatatcttgtaccgcagacacaaaggcaactgcaatggctaacatcattacgggtttaatatcttgtgctggattgaagaagccgaagcaagcaattaaccccaatagagctatctgcgtgaaaaacatccagctacggcgacgaccaaggaaatttgggtaatagcggtcaaacagcggtgccactaaaaatttccaagtgtaaggcaaacccacgatagcaaaaaaaccaatggtttttaaatctacctgttcagagcgaagccacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgttcagagcgaagccacgctggaattaattgatagataaaatataacggcaagccagatgtaaaccctgtaaagacgcagagcaacattttgtaactgaaaatttgccgccaaagagaaacctgtacttgctcgctcattattaccccttatatccattcggattatttttttgccaattccaagtgtctttcatcatttgcgttaaatcgtattgcgttttccaacctagctgttcaagagctttttgtggattagagtaacagaccgcaatatcgccagggcgacgttcaaccaatttataaggcactttaatgtcgtttgcttgttcaaaggcgttcaccatatctaacacagaatagccagtgcctgtacctaaattatagacgtggaaacctgcatcatcttgatgtttttccaacgcttttaaatgcccaattgccagatcaacaacgtgaatataatcacgcacgccagtgccgtcgtgggtttcataatcacaaccaaacacagacagttgttgcaatttgcctacggcaacttggctgatgtaaggtaataagttatttggaataccgttaggatcttcgccaatcagaccgcttgcgtgcgctccaacaggattgaaatagcgtaatacaaccgcactaaattgagggaaggctttcgctgtatcctccaggatacattctaccatatattttgatgtgccataagggttagttgttccacccacttcacaagattcagtaatcgggatctcttttggatcgccataaaccgttgctgatgagctaaacacaatggtatttacattggcttttaacatctcttccaccaacacaattgaacctgtcacattgttttggtagtaacgcaacggctctcgaacactttcgcctacggctttcaagcctgcaaagtgaataacagagtcaatctgattttctgcgaaaatgcggcgtaacatctcacgatctaaaatatcgccttgataaaagcgaacggattttcctgtgatctgcttaacacgctctaaagagatttcagatgaattagataagttatctaatactacaatctctttgctttgatttaataattcaaccaccgtatgtgagccgatatagccagctccgcctgttactaaaattgtcatatgttatccttgtcatgaatttttgttgattatattctgatataatacaaattttaattaaaatttaatgatttactgctctcaattttaattttgtaaataagagcttcttttgaatatcatctaaaattaaatattctccaggagccagagaacctagtttgaagtaactgactccaaccctaactaatcttaatgttggaaatccgatatgagcagtcattctccttacttggcgatttttaccctcaacaatttttaattcaatccatgaggtaggaatattttttctttctcgaattttgggggcactttgccatttaaaatgaggatctgggataattttaactttagctggctttgttaagccatcctttaatattacaccactagctaatctattaagatcttctggttgaggaatgccctcaatctgaacccaatatgttttttctttttcaaacttagggtttgctaaacgatgttgaatttgaccattattagtcagtaataatagaccttcgctatctttatctaaacgtccaataggatagacatttggaatagaaataaattctttcagggttttgcatgcctgattgttagtaaattgagataggaccccgtaaggtttattaactaaaacaactattgtttcatcaaaagtcagtttggcgttattaatacgttgtactggtctaattaaggcagatttgagtttaaacataatgatttttagaaaagttttagagaagttgctggattctatccatactaagctattaaaacaatagaaagctgagagccaattttatcacttgcgccgactaaactgcttcagtagaatgttaactattattcttttattaatatctaatggggtcataacatgtttggaaaaggtggcttgggcggcttaatgaaacaagctcagcaaatgcaagagcgtatgcaaaaaatgcaagaagagattgcacaattagaagtaactggcgaatcaggagctggcttggtgaaggtgacaattaatggtgcgcataattgtcgtcgtatcgaaatcgatccatcgttaatggaagatgataaagaaatggtggaagatttagttgctgctgcattcaacgacgcggttcgccgtgctgatgaaatgcaaaaagagaaaatggcaagtgttactgcgggtatgcaattaccaccaggaatgaagttcccattctaattatctagttaatcactttaaaagtaggggcaaattgcccttgctactatttatatcatatcacttatgcaaagtagccctttacttgaaaatcttatggaagccctgcgtgtattgccaggggtcggtccaaaatctgcacaacgtatggcgtatcatcttttacagcgtaaccgctcaggcggtgtgaatttagctaaagcattgagcgaagcaatgactcacattggacattgcaaatcttgccgaacttttactgaagaagatgagtgtgctatctgccaaaactaccgccgccaaatcagcggacaactttgtgtggttgaaatgcctgcagatattcaagcgattgaacaaactgggcaattttcagggcgttatttcgtattaatgggacatctatctcctttagatggaatagggcctcgtgaaattggtttagatttattacagaaacgcttagaagaagaatcttttcaagaagtgattctggcaaccaatccaacgattgagggggatacaaccgcaaattatatcgctgagatgtgttctattcacaatattaaagttactcgtattgcacacggtattcctgtcggaagtgaattagaaatggttgacggaacaagcctttctcattcatttgtaggaagacgggatatttctttataaataatttcttactagcctatcaggacgttttgctgtaaactacgctcccgtcctgatggtttattccattccgaatttcagctctatttatcacataaaaggcagacaaaatggcaacgaattatattttcgtgacgggtggcgttgtttcttctttaggaaaaggcattgcggctgcgtcgttagcatcaattcttgaagctcgtggcttagatgtcactattatgaagctcgatccttatatcaatgtcgatccaggtacaatgagtccaacgcaacacggtgaagtgttcgtaactcaagacggtgcagaaacggatttagacttaggtcactatgagcgttttatccgtaccaaaatgaccaaagcgaacaactttacaagcggtaagatctactcagaagttttgcgtaaagagcgtcgtggtgactatttaggtgcgacgatccaagttattccacatattacgaacgaaatcaaagcacgagtgattgaaggtggtaaaggtcacgatgttgcaatcgttgaagtgggtggcactgtaggcgatattgaatcactgccgttcttagaagcattacgtcaattagccgttgatgtggggcgtgaaaaaacattgtttatgcacttaacccttgtgccatatatcccaacggcaggtgaagtgaaaactaagccaacacagcactcagtgaaagagttgctttctatcggtattcaacctgatgtgttgatctgccgttcagatcgtatgatcccagcaaatgagcgagcaaaaatcgctttattctgtaacgtgcctgagcgtgcggttatttctctcaaagatgttgattccatctaccgtattccagcgttattaaaatcgcaaggtttagacgatttcatttgtgatcgcttccgcttaacttgcaaagaagcagatttatctgaatgggaacaagtgctgtaccaacaagcaaacccaacgggtgaagtgactatcggtatggtcggtaaatatgttgagttaccagatgcttacaaatcggtcaatgaagcattaaaacacgcaggcttgaaaaatcgtttaacggtgaacattaaatatattgattcacaagatgtagaaaccaaaggtgttgaagtgttacaaggggttgatgcgattttagtccctggcggttttggctatcgtggtgtggaagggaaaatccgtaccgcacagtatgctcgtgaaaataaaattccatacttgggtatttgtttaggtatgcagattgcattaattgaatatgctcgtaatgttgcaggtttaactcaagcgaactcatcagaatttgataaacactgtccacaacctgtcgtgggtttaattaccgaatggcaagatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccgtcaccgctatgaagtaaacaatacattacttccacaaattgaagcagcaggcttgaaagtgagcggtttatcggcagatcgtaaattagtcgaaatcatcgaagtgccaaaccacccttggtttatcgcagcacaattccacccagaatttacttctactccacgtgacggacatccgttatttgaaggatttgtaaaagcggcaaaagagcatcaaggtaaaaatgcttaatgattttagggcatagtagacaaaatggttgctatgcccttttgtctactatgccgccaaattcccctctaaaagtcatttttctttcaacttttagagggaaaacaacagctagtataaaaccctagccctaatagttccatcaatctctttcaagcgttttaatgcctcgcccgtttgttctgtttcaacgtcgataaccacataaccaatcgtcggatcggtttgtagatattctgcggcaatattcacattcgcatcaacgaagactttattgagttgatttaaaatacctgggcggttttcgtggatatgcaataagcgttttgtgcctttatgttcaggcaaggaaacttctgggaaattgaccgctgataatgtagagccattatcagaatattttacaaatttacttgagacttcagtgccaatattttcttgtgcttctgatgtagaaccgccaatgtgtggggttaaaatcacattatcaaattcgcaaagtggagactcaaacggatcgcttgcagaagctggctcttcagggaacacatcaagggctgcgccacgcaatttgtctgtttttaatacttcaactaaggcatcaatatctaccacagttcctcgcgctgcattcactaatactgcaccttctttcatctgggctaaacgttttgcgtcaattaaattttttgttgaagcattttcaggaacgtgtaatgaaatcgcatcacaggttgaaagcagttcttcaaggctagcaacttgttgagcatttccaagcggtagtttattttcaatatcataaaaatacacttgcataccgatagactcggcaataatgcttagttgagaaccgatatgcccgtagccgataatccctagtttcttaccacgcacttcatttgaacctgcggcagatttattccaaatgccacgatgcacttccgcatttgcttttggcacttgacgcattaacacaatgatttcacctaacaccaattcggcaacggagcgagtatttgagaaaggagcattaaaaacagggatcccacggcgctttgctgcctctaaatcaacttgattggttccgatacaataacagccaatagcgaccaatttttgagcttgttgtaagacttcatctgttataaaagtacgcgaacggataccaacaaaatgagcatctttgatcgcatcaattagctcttgaccatcaagagcttttttatggtattcaatgttggtatagcctgcatttttcagaacatcaattgcattttgatgaacgccttccagcagtaaaaatttaattttagatttatctaaagaaactttggttgtcatattgccttccttatacagaagagagttgagtagcaacccccaaccctccgtagtgatttttcttattcaataatttttgcaccatcaggcgtacctacgatggtcacattcgcataacgttgtgcaaaaatcccgttagtaacaacacctgcgatattattgatggtatgttccatttttaatggctcaaaaattttgaagttatacacatctaaaatcacattgccattatctgttacaacgctttcacggtattcgggcgatccccctaaggctactaattgacgagcaacataagaacgagccatcgggatcacctcaacaggcagagcgaaagtagagcctaacacatctacttgcttacttgaatcaacaatacagatgaatttttttgcaagtgaactcacaattttttcacgtgttaatgccgcaccaccacctttaatcatataaccttggggggtaatttcatcagcaccgtcaatatagacatcaagctcagtcacttcattggcactaaatacctcaatacccaatgctcttaaacgttcttcagatgctttagaggcagcaacagcccctttnnnnnnnnnngccatttcacctaagacatcaataaaacagttaactgttgagccacttcctacacccacgatagtgtcgggtttaacatattgcaaagcggcacgcgctgcaattttcttcatttcaagttgatccatagcgccctccttaaagcaaacgtttgcgttattatagtctaaaaaagaacaagcggtaagatccttgcaaaattttgcagaaatcttaccgcttgtcattagttgcgtttcactgcttctgcaatttcttgcgcacagctttgtgctaaagcaccgtcttcgcactctaccatcacacgaattaacggctcggtgcctgatttacgcaataagatacgacctttgccagctaagcgttgttctactgcttttgcaacagctttaacgtcttcactgtctaatgggtttgcaccaccagcaaagcgaacattgattaacacttgtgggaaaagtggcacagctttcgctagatcattcaggcttaatttatgtgatgccattgcagccaatacttcaagtgatgcgacaatgccatcacctgtggtatttttgtctaacacgataatatgccctgagttttcgccgccgagtttccagcctttttcttttaagacttcaagcacatagcggtcgcccacatttgctcgtgcaaatggaattgccaactcttttaaggcaagctccaagctcatattgctcattaatgtaccaacgacaccaccgtgtaatttgcctgaaggcaatgcttcacgtgcaataataaagagaatttggtcgccatcaaccttgttacctaaatgatcaaccataattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcggtcgccgtcgccatcataagccaagccgacatctgcaccagcttcaaccaccacttgttgtaaagctttaatatccgttgcaccgcatttctcattgatgttcaaaccatttgggtgtgtgccaatttcgatcacttctgcccccaattcacgcataacacttggggcaatgtggtaagttgcaccattcgcacaatccaccacgattttatagccttcaaggcttaaatgtgatgggaaagtgcttttacaaaattcaatgtaacgtcctgcagcatcattaatacgacttgcacgacctagctcagcagaagccacgcaatccatcggttgatcaagcattgcttcaatggcttcttcgacttcatctggtaatttttcaccgattgcagagaaaaatttgatcccattatcatcataagggttgtgagatgctgaaattacaattcctgcttctgcacggaatgtacgggttaagtaagcaatcgcaggggttggcatcgggcctgtaaaggcggcagataaacctgctgcagccaagccagcttcgagtgcagactcaagcatataacctgaaatacgggtatctttaccaattaatacctgtttagagccttgagtagcaagcactttacctgctgcccaccccaatttcaatgcaaaatcaggcgtaatcggaaattgccccactttgccacgcactccatcggtgccaaaatatttacgttctgccataaataattaccttaaaaaatattgatatgctgggctatcattaacatcttgatagcggtaacctaatcggtctaaatcttgtttaaacgcctctttttcactgctgttcacaacaaatgccgccaaaatgtcaccataatctgcaccgtgagcacggtagtggaacagcgaaatatcccaatcaattaacgattgcaagaacttcaacaacgcccctttctgctctgggaactcaaaactgtataattcttcttgctgaatagaacttgggcgaccaccgaccatataacgaatatgggttttcgcaatatcatcatcggataaatctgtgacaggatagccattttgttgtaaatctttaatgatctctaatttttcagcattcccactaatacgcacaccaacgaagatacaggcttgctgatcgtctgcgtgacggtagttaaattccgtgacagcacgattaccaataatttgacagaacttgagaaatgcacctttttgttcaggaatagaaacggctaggagtgcttcgtgtttttcaccgatttcacaacgctctgacacataacgtagtgtatggaaattaagatttgctcccgataagatacaggcgagatttctaccttcaagattgtgttgagccacatattttttcagtccagctaaagacaatgcccccgacggctctgctaccgcacgcacattctcaaacacatctttcaatgccgcacagatttcatcgttatcgactaacacgacatcatcaacatacttctgacataaacggaatgtttcatcgccaacacgtttaaccgcaacaccatcagcaaataaaccgacacgttctaaatcaacaggttgccctgcttgcaaagcataaaatagacaagcggaatctttagactcaaccccaattactttaatttcaggcattaattgcttaatcagcacggcaatgcccgcaatcaaaccaccgccaccgacaggcacaaaaatatagttcagatcggcattttgttgcaataattccataccaatagagccttgtcctgcaatcactaacgggtgatcgaacgggtgaacaaaggtcatattcagctcttgggaaagctcaatcgctttggctttggcttcatcaaaatttgccccatagagcaacacttccccaccaaaaccacgcaccgcatcgactttgattgacggcgtattttgtggcatcacaattaacgctcgcaaaccgagatgttttgcagacaaagcaaccccttgagcgtgattaccagcagaagccgcaatcactcctgcatttttctgagctggagagagattagaaatcatcgcataagccccacgcagtttaaaactatgcacaggctggcgatcttcacgtttaatggaaatatgattacccaaacgctctgagagcttttccattttttgcaatggtgtaacttgggcaagatcgtagattttagagcttaaaatggcacggaggtaatccgtgcctgattgtaatggggtatcactcatcgttcaaccaacctttaattagtgattgcagccgcaaccgccgtgtccgtgatggtggtgatgatcgtgaccacagcaaccgtgatcttcttcatcgtgatcgtgaccacagcaaccaccttcttgatgaacgtgaccgtgagcaatttcttctaatgtcgcttcacgagttgcaaccacttccacagagaataataattcttgacctgctaacatatggttaccatcaacaacgacttcgtcgccatcaacttcagtgatcaccacaggtaatggacctaaatccgtatctgcgataaaacgcatacccacttctaattcatcaacgcccataaacacatcttttggcacacgttgcaccatattttcattatattcgccgtacgcttcttctggtttaacacgcacttcaaaagtatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaccgctttaccttctaacgcattttctaaaccgataacaagattgttgtgaccgtgtaaatattctaatggttgctcaactggtgcttcatcaactaatacgccatcttgagtacgaacttggtatgcaatgctaggcacaacatttttggtaattttcatttaagtatccttattttattgggtaaaaagttctaggcattgtagcttgttatagaggatttgcaaatgttagtaacaaaatgaccgcttattcttacaagcggtcaaattttgaaattaatccacaatatcaggtgtcaccgcatcaaccacatcaacggcagttccaacaacaccaccaacaacagaagtgactaaacagccacttaccgaagtgcaaagtaaagtaagaccgagtaacttaatccatttcttcatttcaagcccttacttttcaaatttcacctgccccgaagcaaacgcagaaatagtggctttgcctgtctcaagtggaatatccacatctgcctctttcgcataacttgcggctcttagtgcgattggacggctatgatgttcctgtccgttaggggtttctaactgaacattactaataatataacgtttcgcatttagccctttttgaataacttcggctttgcgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaactgagcaataatgtctaacgtcatttcatcttcaagagaagctaatttttcaggcgacacactaaaatgaatttgaccaatcgccacatcatcgcctaaattctcaagcacctttgccatagcgtcaaaatttttacttttcaactgaatgcgaccttctgcgaaccagcctgtcaccttacctttattatcgtattctggatagttactaatgccatctgtagataactcaatgcttttatcttgtttcgctaattcaatcacctgattgagatgagcagaaacttgctttttcagttcattcaggtttttacctgacattctgctatatacctcagctttcatcagatctttatccaccgcacgacttacttgcgttgaaaactggaaagtcgagttggtatcaaaggtatttggctctgccgatacagccaatgaggtaaatacaagcggtaaaatggctaaatattttttcaatgtcattctctattccttttatatcagggcgtaaaacaccacttagaacgtatttctcttgattagttcaatgtttaaaatatgtgcaagatcctgtcgcaccttatctatctgccaagtcacgttatagccagccaagtgcataccataaattcgctcacttggtttactttgctgatatgcgggtcgagggtcttgtgcaaccacatcacataaaaattgcacaggatcttcaatgccaaatttcgcaaagttctgacaagatttgaccgcttgtagtgcttgctcagtcaaaagcacttgcaatttcacctcaggtttatcttgagcaaaccccgataacgcattcggttcactatcagcataagcaacgtaaggtttaatatccaaaatcggtgtaccatcgactaaatcaacactgcctaaatgtaaataaacctcgccctctttaacttcaatacgatctaatgccaccttcgataaacctaacggatttgggcgatgtgtcgcacggctggcaaatacaccaacacgctcattcccacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccacccaaacggggagggcgaacagtagcgtgccactctcgttcaggaatttgatgaaattgaaaaataagccaaagatggctaaattgctccaaacctcgtactgcatcaggcgtattataaggtggcaacaaacgcaaaatacctcgcccttcacggactaaattgggctgacgaggaacggcaaatttttccccataaggtgtttgtatcgttccaatgggagaaagggttaaagaggacggatttgtcataaaaaggcaaattttctgttaaaaatcaaaacatataagaacattttgtaataaaatacacagttttaaaagaaaaacttcattaaagtgactaatttattgatatgaataaaggttctatgttctctatttggctttcaacggctcgcccaaaaaccttaccgcttgcattagcttctattnnnnnnnnnnnnnnnnnnnnnnnttggcaaggaaaatttgattggctaaccaccctactggcttttatcacaacgattttgttacaaattttgtctaactttgctaatgattatggtgatcacatcaaaggatctgatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtattgattggttatgcttatcaaagttggcaagatcttattgtttttgcactacttggcattttagcgattgtcgcagcaattacttacaccgtaggaaagaaaccttatggctatttaggattaggcgatatttccgtactcattttctttggatttttagctgttttaggtacattctacttacaagcccataccctacagcttgatctattacttcccgctttcggctgtggtctattatctgtggcagtattaaatatcaataacttacgcgatattgagcaagataaacaagcgggtaaaaatacccttattgtccgtatcggtagccagaatggacgtcgttatcatcttcttttactcagtttagctgtactatcctatcttttattcactctgatgaattttgctcattggtacaatttcctatacttattagcaatccctttactagtcaaacacggtttatttgtttaccgccacaaacatccaacagaacttcgtcctatccttggacaaatggcaggattggcattgataacaaatttgctgtttgggttgagcatcatgttataaatatgggattaactggcttacagtttatatatctttatagcttctccgctttctctggcagtaacacaggaatgccattttcaattgggtaagcgacattcgccgaacggctaattaaacggttgttttctttatcccactctaattttgtttgagtgattgggcaagcgatagtattaagcagtttttcgttcattctgttttctcactaattcaaggacgggttctaataaacaagcgggatcttgtgctgaaaattttgcagaaacaggcacataccaccaattcggttgagcaaagttacggcattttactgcatctttttcggtcattaatagcggtaaaccgtctttctgcaaaggttcgatgatttctaatgcgtagggctgatgatcagcgaagccatagctttctttaagttgaataccaagatcttgcaacatcataaaaaaacgaggtggatagccaatgccagcaagggcaatcactggctgatgacaaaaatcggctatcggttttttctcccctgtttttagattgatcacccactcaggttctaactgcattagatgttcgcctgcttgtgcagattttccgttgcaaatcaccgcttgcactgattttaaacggcttggaagctctcttaagccccctgctggcaagacaaaaccgttgccaaaacgacgctcgccatcgacaacaacccactccatatctcgttcaagggcgtaatgttgtaagccatcatcagtgatgattaaatctaactcaaattggcttaataatagctcaatactttgtcggcggttcggcgaaatggcgactggagcgagtgttcgttgcgcaatgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttttgccatttccgccaacagaaatatttcccaccactaagactggcacaggcgagcggtaagatgttaggatttttttgcgatatagcatcactcgaatttggctaatcaaccaaaaaagcagagagagtggggctagtagccaagtgatgagggattttgtttgccagatgttcatagttgttatacgtaaagtcatttatatgtttctatgatgtactgtccattctatggcatcaaataagtaatgtctaaaaaataaattatttttgtaagcataggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtaaaagtagttgattccagcatagtatgactataaaataaaataataatcattatcaacttatacataacaacatgaactcttatagacaacaaatcacccagcttcttgctgaaaaaccgaatatgattacccttgaaattgcggaaaagttagatctcccagaagggcaagtgctttgcaatttaccaagtgaatttgtccgcttgttctctgcggatagagcggaagagattctacaagcgatcagtcaatggggaacatttacaactatcatcgaaaaagaaggctccatttttgaaattaaagaccgttttccaagcgggatctttgctcgaggttattacaatttgaatatgaaggatcaagaaggcacacttcacgggcatttaaagcttgataatattgctcgaattgcctttgttagcttgccgtttagagggaaagaaagctacaacattgcttttattgcacataacgggcaaaccatttttaaagtgtatctcggtcgagatgagcagcggcaactcttcccaacacaagttgaaaaatttaagacatttcaataaaaaggagcgataaatgtcaaatcgtcaagaagtattacaaaaccgtttagggccagaaattcaagaatttaaagcaaaaatgaaaacattggtgcttgccactgtggataaagagggaacccctaatgtaagttatgcaccatttgtgatcaacaatggtgaatatcaagtattgatttccaccattgcccgccacgcacgcaacctacaggaagtgccgaaagtgtcgttaatgttgttggaagatgaaagtcagagccgtgaaatttttgctcgccgccgtttgaccttcgacgcaaccgctcgcattgtcgaacgccacagtgaagagtggaatgatggcattgccaaattaaaagcccgtcacggtgatttagtcgatgagttagcaaccttacaagacttcaagctgttctgctttaaaccacaacaaggattatttgtaaaagggtttggtaaagcgttccaagtaagtgctgatgaattagtgaattttgttcatcttgatgaagggcataataaagaaatcggtccgcacgagaaagaggcataaaacacaagcggtcagttacagtaaatcctttaccataactgaccgcttgtctattgatggaaactactcagcgtcttctttcgcccattctaatgaacgtttaaccgcacgtttccaacctttgtatcgttttgcacgtttttcttcatcgctgtcaggtgagaaggttctttcgatttctgctttaccacgtaactcttccaagctgctccagaaacctgtcgccaagcctgcaaggtaagcggctccaagtgcggttacttctagcactctcggacgttctactttggcattgagaatatctgcttggaactgcattaagaagttgttcgcaactgcaccgccatctacacgtaaagttgctaatttcgcaccgctatccgcttgcattgcgtctaacacttcacgggtttggtaagcgatagattctaatgttgcacgcacaatgtggttacggtttgcaccacgagataagcccacgatagcaccacgcgcataaggatcccaatatggcgcacctaagcctgtaaacgcaggaacaacatatacgccatttgtactgcttactttcgttgcaaagtactctgagtcacgagcgtcgtggataattttgaattcatcacgcaaccattgaattgaggcaccagccataaagattgaaccttctaaggcatagcaaggttcacctttggcgttacacgcaatggtggttaataagccgtttttcgattcaaccgcttgatcgccagtgttcatcaacataaagcagcctgtgccgtaagtattttttgcttgaccagattcgacacaaagatgtccgtaaagtgccgcttgttggtcaccagcaatccctgcaacaggaatacgcacgccgcccataccgccaatgttggtttgtccgtaaatttcagaagaatttttcacttcaggcaacatttcacgcggaacatctaataattccaacattttgtcgtcccactgttttgtgtgaatgttgaacaacattgtacgagaagcgttggtgtagtcagtgacgtggcttcttccttgagtcaatttccagactaaccaagtatcgaccgtaccgaataacaattcgccttttttcgcacgttctcttgcaccttctacattatccaaaatccatttcacttttgtgcctgagaagtaagggtcaaccactaaacctgttgttttacgaatatagtcggcgtgaccttctgcttttaatttttcgcagaaatcagatgtacggcgacattgccatacaatcgcattgtaaatcggtttacctgtttctttttcccaaacaatcgtggtttcacgttggttggtaataccaatcgccgcaatttgatcggcttttaccccagcttttgcaacgacttcgtttaaagttgaactttggcttgcccaaatttccatcgggttatgttcaacccaacccgcttgcggataaatttgagtaaattcacgttgagccacttcaacaatgtttgcatttttgtctaataacaccgcacgagagcttgttgtaccttggtctaaggcaatgatgtattctttagtcataggatcacctctgaaaattatttaagattgcacggtaaattcttaccaataaaacgagtatagataaagccacctaataaagccccaacaatagggccaaaaataggtactaggaaataaggaatatcacgtccgccagtgagcgctatatctccccaaccagctaagaatgcaaagagttttgggccaaaatcacgagcagggttcatcgcaaagccagttaatggccccattgcaccaccaatagtcgcaatgagtaaaccaataagtaaaggagccattgcacctcttggtaaaccgttaccatcatccgttaaagcaaaaattaatgccattaatacggcggtaatcaccacttcaacaaagaaggcttgtaatacgctgatatgtggattaggataggtcgagaaaacacctgcaaagccaacaccttcaccacgcacaatattttgtgccgcttcactggcagcaaaaagatctttatataagaagtacactaatgctgccgcacagaaagcaccgagcatttgagaaataatgtaaggcagaattttttgccatcaaaacaagcgaatttccataacgcaatagtaacagcagggtttaagtgagcaccagataaccccgcagaagcataaacagccattgcgaccgcaagtccccacacgattgaaatttcccacaagccgaatgtggctccagcaacctgtgctgcggcaacacagcctgccccaaaaaagataatcaaacctgtaccaataaattcaccaatacaagcagcttttaatgatttgtccataaattccccctaaggaaattaaattagaaagtaaaaatgtttgaaaaagaaagttttcgagggtgagatataaaaaaagaacattttacgcaaacaattaaataaaaatttgtgaagttgctcacaatttttttaaaaaagaaagtgatttttgtgaaatgttaatatgtatcccaaatacgttacaaactttataaccgttttgttagataaaaataagcatatttcattaatctcaactgtcgtttccagcgagtaggctgatgtaaaatacgaaacaaccactccaaacctaaattttgccaacatttaggagctcgcttaaccttaccgacaaagacatcataagtgcctcctacccccatatatagtgcatcaggataaagttgctgagctttttgcataaatttttcttgttttggcgagcccatcgccacggaaataaatttcgcaccactcgcttttattctctggataatttcttcttcctgctctttagcgaaataaccattttgtgttcctaccacttttacttgccattcctgcaatttcattgctgttgcttgtaaggtatcctctgagcttccgactaagaaaacaggtaaacggcattctcccaactcagccatcaacctctcccacaaatcagcgcctgcaatgcgttcaattctcgaatacttcggatatttagatctaatagtacaaactacacttattccatcggcatatttatattcagcctcctctaatagccttttcatttcattatcttcttgataaatcataattttttcagcatttattgctatcaatttacctgttagaagaactccattattcaataaataggctaccaaagtttgctgattttcaacggctaataactcaactccaccaactgatactttattcataccactctctcaccctatttatcaaataggctactatataagcaaatacaaaaatcacactaaagaagcagaaccgtgaaataaaagcatctatgccttctcgtatcaatacaatcaaattgaacaaatttgccaaacaataactttgaataactgcagaattttttccataggcaaaaaaattatcaaagatacgtattaaaccaccaaccaccgccattcctatagcaatcattggtatcccccccataatataaaaagagcctaataacgttggcgacatagctaaaccagaaaagttacctaatacacttttcgtgaaatagtttgctgtattccacacgatgtctgggcgttcctcccataatgattgaggaatatacacataaaaatcacgcacgataggcattaatccttgaaactcaatctctgcatccattatttttgctacattttcccaaggcgaaaaggtatcacgtgtcaaataaagaaaagtgtaaaatgcttccgaaccttgtacattaagccgataccgccataatgccaacaaaaacattgcaataactgtcaaaagccctgccctcaccagccatttaaatgataaaaacctccgcaaataccccaacagcataaacataacaaaggctaatgcaaggttagctcgtgtgcccccaacagctaggtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaacaccccaaacgtcattccagctaccaaaaatagccaccaactttctttagtaggctttaagaaaaaccaaattaacaaggcgggtaaaaagaaataaaagaaacgttttaaagccacaccactaacttgagcagaaaaaatgtggctatatttttctaatttgaataacaatagcccttgatttaacaacataaatcctaataggctcagtattgcaatcatcattaaaatccaagcggtcagatcagctagcgattttacctccaccgcataccttggtatttgcttatttctccctatataaagataactcacgtaatagataagatagccacctaaagctattgctagtatgttccacaacattgagatggcaggaaggcgatattcaaatagccctgccatcgtcatcgaaaaaggaaacccaccgaaaaaggtaataagatagatgccactaaacagcaaatggaatgaaaagccttgctggcgataatctcgttgaattatccaaaccaacacacttatagcgattacataaaaaaggattaatcccgctaacatgttaatgttccttaaacaaggtgggtaatttttactgaaattataccgcttgtaaaccaagagaatgtaaacagttcagccattcttgcttataacttagggggaaaaaagtaattttacttttatcaagtaaagccaactgggatttaactcgtataatctctgagtcactgatttcatctgcgaaaagaaagctaattccctccgcttgtaaatcttgttgaaaaggatttgctctatgaatggctatcgggatgttcatctgtatgagtaaacacatcgttccgatcccttgctgacgctcaaaaggaaagtaaccaagatcacattgagacagtagctccaaataagcctcaaattctaatttccgagtgataatgtccacctgcccctgttggaagtcttgttccgcttgttggcgaacttgagcaatatattttgaattacctgcgggataccccatcggcacgactattcgtacattttcgccaaatatctctcgaatttgctttaatccaagtaaatgttgattgctcggatcgccagaatttcctaacaaaattgtccgttgatatgaacattttttagtcggaaaattcgtaggcattctagttggaaaataaagccgttgatcaagagagctcttacgttttaattgttgataagcgtgatttaaatctcctaaagttccccacaagcgtgctattttacgttgtgcaagtcttcgcaatggataaaacaatctaaactttaaagaagaagagagctcataaagatctgctccccaaatatgccaaacacaacgatttgctgggactaatcctaacaagatagctaaccacaacgatgcattgaattgcccatgtagcacaaaccaagcggttggttcctttcttgcaattttgataacttcttgagtgagtaaatattcatctggatatgaattaatatctaataatgtaaaagtttcagacaaatcactacgactaacaacataaaaatgaaaagcattcggtagttcatccaataattcattttgaaagaaatttagtattgtgtgattgtgatggggaatattagcccctaaaacatggattatatttgccatattccatctataccatattaaaaagaatagtcttgatgtgacatataaatcactatttaaatgttgccaagtgttcctatgatatttaatcctttgacccatgctttaatattcatttcacattaatgacattatctataatttttggtaaatatattgagcaacaatagagaaatatacgtgagatttgaaaattttcctgtaaaattttacctcataagttgaataattatagccagccataatgttaaatacaaaagaaaaacagaaagaacccatagcgaaaaagccctactttatcccaacttgcttaaaactagctctcttagccacttgctatgttgggatatacggcatctatttagatggaaaaattcgttctaaaatggacgggcaaatttggcaattgcctgccgaggtctatagtcgtatcgaaagtgttcgccttgatgacaatcttacccttgagcaagtcaaactcgccttgttagacaatggctatcgtgaagtttcattaattgcaacaccaggtgatttcaaaattgaaggtgacaatcttgttttgcttcgccgtgcttttcctttccctgaaaatcctgaagctcaacgtgtactgcgtttacgctttgtcagtgataaactcgctcgtattgaagatttagtgcaatttaaagaggtcgaggaatttcgtcttgaccctaaaatgattgcaatgttgcattcggataacgatgaagaacgtcaagcgttacgtttgcaggattatcctcgtctgcttattgatgcgttgctacttaccgaagataagcgtttctatcaacacgaaggaattagtccactggggattgctcgagcctttttgacaaactatcaagcaggcagaacagtgcaagggggcagtactttaactcagcaattagttaaaaacctctttctaagtaatgaaaaaaccttagtgcgtaaagtaaatgaagcgttaatgtcgctgattttagattttcgttacgataaaaaccgcattctcgaaacctatctaaatgaaatttatcttggtcaaaatggtagttatcaaattcacggttttgctctggcaagtcaattctattttggtcgtcctattcaagaaattaatctaaatcaaatcgctctgctagtgggaatggtgaaaggtccgtccctctataatccgtggaaaaatccagaaggggcattagaacgccgtaatgttgtgttgcgtgtattgctagaacataaggtgattaatcaagaattgtatgatttacttagtaaacaatcgcttggcgtgaaagagaaagggaatatctatcgtcagcaacctgcgtttatgcacgccttaaatttagatattaaaagtcagttgggtgagaacaaatctgctctgctgtcaggggcaaaaattttcacgactttagatagaaaacaacagcgttctgcggaaatggcggttatcaatggggtatccgaattagaaaatagcagtaaaaaaatcaaagagttgcaatctgctattgtggtggcggaatataaaacgggtaaagtacgggcgattgtcgggggagtacagacacaatatgctggctttaaccgtgctattcaaaccaagcgtcaaatcggttcattggttaaaccgtctatttatgccattgctttggcaaatccgcagtatttccgtcttaacacgccgatagctaaccaaccgattaccattaccgttggaagtaatacttggacacctcgtaactatgatcatcgttttagcggttctgtgatgttaatggacgctttggttcgttcccttaacattcctacggtaaacattggaatgaaacttgggctgaaaaatgtgattgccaagcagaaagaaatgggctgggataatgccgaaattccaccttatcctgcgacattactcggctcttattctatttcaccttatgatgtcacgaagtcttatcaggttattgcaaatgctggcttaaaagtaccgcttaccacaattgaagcaatcatatccccaacaggtgaaatgatttatcagcctgttctcacgcagacaagtaaacgcgttttgcctgcagaagccacgattcaaacactttatgcaatgcaacaagtaacggagcgaggtacggctcgtagcctacaggcagattttgcacaactgcatatcgcaggcaaaaccggcaccaccaacaatgcacgagatacttggtttgtcggcatagacggtgaaaatgtcacgaccgtttggttaggtaaagataacaatagcgatacctatctcactggttcaagcggtgcattgcaaatatataaagagtaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaaacgtgctgaacccttggcgttcaagctaccaagcataccaactattcaatgggtaggtatcaacagctacggctcttgggactgctccagccctcatcaaattcctgtttggaaagataaaggacaacgctattgtacgggtggcggttctgtagttgaagtaaaaccaagtgtgtgggacgcattatcactaggtaaagacacccttcaaacccaaccgaataaagccgatgaagcagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacaagctccgattgaggaagaaccattagaggaatagattaagaacggcatagtagacaaaaattacgggcaaagggtcattagttttcatctactctgccatatcttacaattcttacgccttttccgcctctaatctttcaaaagaaagcactttgcgttcaactctgcgtaagattacggtcataatccctgtaataaccaaataaaccgcacctgctaaaccatagatggttaatgcgtcatactcagttccataaagctggcgagcatagcccataatatccataatggtaatggttgaagccagtgatgttcctttgaacaccaagataatctcattgctgtaagacggtaatgcccgttttaacgcataaggaacaaggattttcaatgtctgtaatcgacttaatcctaatgccgcacaggtttcccattgcccttttggtatcgctttgactgcaccgtgaaatagtaaggtggtataagcggcactatttaaagcaagggttagcattgcacagaaccacgcatccgataacaaagaccaaaatggacttgcgacaatccaaggaaactgcccaggacctgcataaatcaagaaaaactgtactaacaatggcgttccagtaaatagggttaaaaagccatttactattccttttactagacgattttccattgaaagtaagaatgtcattccaacggcaaggaaaaatgccacaattaaagaaacaaacgtcagcaataaactagtcgggataccctgagctatcaccataaagtattcttgcaacattatttaccccctctttcaaaacgagtgaagcgtagctctaatttacgaataattacttggctgactaaggttacaccaaggtaaattaatgctgctgtaccgtaccaagtaaatggctgatgggtactggtgttaattaactccgtttgtcgcataatatcgtgtacaccgattaaagaaaccaaagcggtatcttttaataacactaaccactgattgcttaaccctggtaaggcgtgtcgccaaacctgtggcatcacaatgtttacaaaagtatagccacgacttaatccaagagctgccccagactcccactgcccaagcggaatagcttgaatagctccacgcaatgattgagaagcgtaggaagcaaaaataatagatagtgccacgacaccacagccaaatgcaccgagttcgacatattcccctgtgatcatttcaagcacttcaggcacaccaaaatagattaaaaagaccactaaaatttcaggcaaaccacgcaataacgcaacaacaactgtggttggtttacgcaccattgtccatttatgcgtttcaagcaccacaaaaagaatggacaatagtaacccgagcaataaagagcaaactgccaaccctaaggtcattagggttgcagaatacaatagaggaagataatccaaaaacataatgattatttagtcatccatttatcataaattttttggtactcaccgcttgctttaatcgctgcgatacctttgtttaatttttcaactaactcagtgttagattttttcactgcaatgcctaagccattgttgaaataacgtttatctgtcactttctcgccaacaaattgtgcttcagggattttgcctaacatatctcttaacacatcagtgtcaccaaagattaaatcaatacgaccattttttaagtctaagattgcatcttgtaaactcgcataagattttgcttgatattgtttagcttctgccgttgcgtattgttggtaagttgtaccgttttgtacacctactgttttagcagatgctaaatctttaccttgtaaagcaatatagcttgctgaactttcgtagtatggtgctgagaaagccacttgttttgcacgagcttctgtaatatcaatcgcagaaattgccgcatcaaaaccgccacgacctttaattaagctagggattaacgaatcaaacgattgagatttaaattcacaagtcgcttggacttctttacagattgcattggcaatatccacatcaaaaccaacgatttcacctttctcattagtttgctcaaatggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattagtttgctcaaatggcggatagcttggctccattgcaaaagtaattttatcattcgcataagctgaaactgcagttgcggctaaaacggttgctaaaagtaattttttcatagtaactcctattaattgtatgatgttgtgattaatctgaatgtgaaagatattgagcaaattgcgttgtttttggttgttcaaaacagcttgcatcgcccatttcaataattttgccttgttccatatacaccactttagtggcaactttacgagcaacagaaacttcgtgtgtcacaatcacttgggtgatccctgtttgttgtaactctttaataatatcaaccacttgagcggtaatttcagggtctaaggccgccgttggttcatcaaacagcaatacttccggttgcatcattaaagcccttgcaatcgccacacgctgctgctgaccgcctgaaagctgtaacggaaaacgctctgcaaatgcagtaagttgcaaacgtgctaacaaacctttggctctttctaccgcttgctctttcgttaaacctaatactttcattggtgcttcaatcaagttttgcattactgttagatgtggccataaatgatattgctggaacaccattcccacttctttacgtaataatgcaacctgtttcgcattggttttagcggtcagatcaaacttatgatttgcaatctcaagctgacctgattgcggtacttccattaaatttaaagtacggattaaagtacttttccctgcaccactagggccgagtaacacaacggtatcgcctttttcaatgtttacattaatatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacaaggcttggctcgaaccgtaaaagaaattgacattactaatgcgaattgccattaactacttcctatcaaagttttaaaactgaatagatattaaattttattgcataactatgcaagtgatttttgtaaatttgaggtaaaaattttgatgaaaaaattaaaatacatatctgtaattgtaggttataataatcacactgtataaaatcacataaagaggcggagatggatttttctttattacttgacggcttaaacgataaacaacgagaagcggtagcagcccctattggcaactatttagtgttagcaggtgcaggtagtgggaaaacccgtgtgcttacccaccgtattgcgtggttaattggcgttgaaaatatcgctgagtccaatattcttgctgtgaccttcaccaataaagccgcagcggaaatgcgtcatcgtattgaatataccctatcgcaatctagcgaccaccgcttattcggtatgtgggtcggtacattccatagcattgctaaccgcttacttcgctctcattatcttgatgccaatctgccgcaagattttcagattatggatactgaagatcagcaacgtttgattaaacgcttgctcaaattgcataacttagatgaaaagcagtttccacctaaacaagtggcgtggtttatcaatgctcaaaaagatcagggcttgagagcaaaagatctcaaacaatctcacgatgatccccactcacaacaactcgttaaattctatcaaatctatcaagaagcttgcgatcgtgcaggattgctggattttgctgaactcttaatccgtgcttatgaattatttaagcataacccattgattttacaacgttatcaacaacgttttcagcatattctgatcgatgaatttcaggataccaataacattcaatacgatcttattcatttattagctggaaaaacgggcaaagtaatgatcgtgggcgatgacgaccaatctatttacggctggcgtggcgctcaagtggaaaacattcaacgcttcttaaatgattatgacaacgcacaaactattcgccttgaacaaaattaccgttcaacaggacatattttaaattcggcaaatgctttaatttcaaacaatgacaatcgtttaggcaaaaatctttggacagataaaggtgacggcgatcccgttgatatttattgtgcattcaatgagttagatgaagctcgctttgtcgcttcacagattaagcaatggaaagaagatgaaggcgattttaatcaatgtgctgtactttatcggggtaatgcccagtcccgtgttatcgaagaagccctaattcaagccaatatcccttatcgaatttatggcggaatgcggttctttgaacgccaagagatcaaagatgccctagcctatttacgtttaatcgctaaccgccaagatgatgctgcctttgaacgtgtggtcaatacaccgccaagagcaataggggatcgcaccttagatattttgcgtcagcttactcgaactcgccaaatcaccttgtggcaagcaatccaagtggctgttcaagaagaacatctttcggggcgttccgcctcagccttgcttcgctttgtcgaactgattaacgcacttgaacaagaaaccgaagaaatgccactgtttgaacagacggattttgtgattaaaaaatctgggctttatgaaatgtataagcaagaaaaaggggaaaaaggcgaagttcgtattgagaacttagaggagttagtgactgcaacacgccaatttgtaaaaccagatgaagcagaagagatgaccgatctcaccgctttcttaactcacgcctcccttgaagctggcgaaacacaggcttcactacatcaagattatgtggaattaatgacattacattcagccaaaggcttagaatttccacgggtgtttatcgttggggttgaagaagggattttcccaagtggaatgagcttcgacgaaggtcgcttgcaagaagaacgtcgcttggcttatgtcggtattacacgagcgaagaaaaaactcacgatcagctatgccgaaagtcgccgcttgtacggcaaagaagaacgccatttaccgtcacgttttattggcgagctgcctgaagagcatatccgagaagtccgcctgcgtggaagtatcaatcgccctgctacttttgcaaaaccacaagctaatccgaccgctcgtttacaagaagatagtggttggaaaatggggcagaaagttcgccacgagaaatttgggcaaggaacaatcatcaatgtggaaggcagcggtgatcatactcgcctgcaaattgcctttgtacaacaagggattaagtggttaattgccaaagtggcgaagttggaaaagatgtaaaaaaatccccaaccaaatggctggggattttttactttaatcgtaaattactcagaaactacgttgatagttactactgcatttacttcagcgtgtaagtgtaatttcacttcgtgttcgccgatagtacgtaatgcaccttctggtaaacgaacttctgatttagttactgctacgcctgctgctgatactgcttcagcgatatcacgtgcaccaacagaaccgaataaacgaccgtcatcacctgctttagaagtgattacgattgctgctaagttagcgattgctgctgcacgagcttgtgctgcagataatgcttctgctgctttcgcttctaattctgcacggcgtgcttcaaagtgagcaatgtttgctgcagttgccataactgctttaccttgtgggattaagtagttacgagcaaaacctgctttaacagttacttggtcaccaacggtaccaagttgagcaactttgtctaataaaataacttgcattgtactcttcctctcttattactgatggttgtcagtgtatggaagtaacgcaaggtagcgagcgcgtttgattgcacgagctaattgacgttgatacttcgcacgagtacctgtgatacggcttggaacaattttgccgctttctgaaatatagttctttaatgtagcgatatctttgtaatcgatttcaacaacattttccgctgtgaaacggcagaacttacgacgacggaaataacgtgccattttggcttctcctaatctataaattcaatctgttcggtgtgtaagactaactgatttaaatcattgtagtctttgtgagtatggataaatccttttactcgaacttttccaccgaccttcatttgttgggttattaaactaaattgattgcctgccaaaatcacttggattttgcaccacgcttggcgttctaaattgacttctttttgcactgaacgatgttctaggtaaaaagagtaagttggaatacctatcgggcttaggctttgtttaatcgttgttgcgatagtgccacttaagattaaacagttatcaatagacgaattactcgtctgcatcctcagcttcaacttcttctactaaagcttctggagctttacgctcatcttttgctttaagcattggtgatgcttctgttaccgctgctttagtgtgtaacactaagctacgaagaactgcatcgttgtaacggaagttagtttctaactcatcgattacgttttgtggagcttctacattcattaacacatagtgtgctttgtgaagtttgttgattgggtatgctaattgacgacgaccccaatcttctaagcgatgaacttgaccgcctgcttctttaacagaagcggtataacgctcgatcataccaggtacttgttcgctttggtccgggtgaaccataaaaacgatttcgtagtgacgcattgtcgatccttacgggttaacagcctccaaggttgccagtcaccagcgttggaagcaaggattaaaaacaggtgtgactgaagccgtgcattatacggataaataaaattcgtacaagtaaaagttaatctgcatagcaaaattaggcataaatctatctgcttatggtggtttttagcattagatattaaaaaatttttatccttttttagcatggtaaaaacagaataaaaaactaatttatctaaaatataagaataatgttcttgttatagtgctttaattggcgtttatgagtggttgtatagattttaatactaaaaatagggttgttttattggttttggcgtgttaatttacactctctttttttcggaaacctttggatttttgacaatgacaactcatactctaagaaataatccacgcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggcgattgcagcaatgatcgggactgcaattgaattttttgactactacatttatgcggcagcagctgtattagtatttaacacccaattctttaacagcgatgaccctgtttcaaatgaattactttccctttctacattagcactagcattcttcgctcgcccaatcggttcggcacttttcggacattttggggacaaaatcggacgtaagaaaacccttgttgcttcattattattaatgggcggttcaacggttactatcggcttattaccaaactatgaaagcattggtatctgggcaactattttgctctgcttatgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtaaacgtgcttggtacggtacattccctcaattaggtgcgccaatcggcttattcttagcgaactcatcattcttcttagtcagctacattttcggtgctgaagccttagtagaatgggcgtggcgtattccgtttgtttcatctatcgtacttgttgccgtaggtttatatgtacgtcttagcttacacgaaagccacgtttttagagaagctgaagctcaaggcaaaaaacacgcagcacctgtaagcaaagtatttaaagaccacttaaaaccgttgatcattggtacattcattatgacagcgacctatgtgttgttctacattatgactgcctttgctcaaatttactcaaaaagtgcaccaacgctatcaccagcaggacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaatgggcctaggtattccagctaacacatttacaggattactcttattaagtgcaattgtatttggtatcttcgttagcctgtcagggatttttgctgacaaaatcggtcgccgtaaatggttaatctatgtgacaacaggtatcggcattttcggtttattaatgcctttcttcttaggaaacggtacaccaatgagtgtatttgcattcttagtagttggtatgatttttatgggaatgacctttggtccaatggcggcattattaccagaattatttccaacagaagtacgttattccggtgcatcacttgcctataacttagcatctattgtaggtgcaaccattgccgcaactttcgcaattaaaattaatgcggcttatggcttaatcggtgtggggatctaccttgcaattaacgcagttatcacattgattgcactctttgcgtcaaaagaaacgaagaatttggatttgactgaagtgtaaatgctacgaattgtaagttcatttttaagtttgaaaaatagtatcaaaaaagtggcttaatctaaaccacaacctattcaacttctcaatttcaggctgatattccaccattttggcaacacaagcggtgggatcaaagcctgatttggcaaaataacgtgctaagaaaaacgccttttgttccgcagacaaaggattgttatgaaaaagcaacgctaattccaaggcaggatcggagatcgctgcatattcccaatcaatcaaaaagagtttttcatcttgttcgactaaatttgcaagatgaatgtcgtgatggcaaatggcttgttgataggggctaatttgctgaaaagggggcgtgaaattgaggctgttttgcgtttcaagcggtaagttttgccataagaattggcaacgttcggcaagatttaaggttgtcaattttgtcgtggaacgcaccgcttgccaatcaaagagatgtaaacaggctagttggtcagctaatttttcgagtaacggttggctaaaatggctgggggtttgcccatcaagccacgctaacaaagcagaggttttgttagcataaataaccttaggggcgaaaccgagtggctcaattagtcgtaaaaaagcgacttcttgttggtaatcaatgccataatcggtggctcgttgcgtttgagaacgtaaaatataacgttcgccattggctaattcgaccaaatgactacaagcggtcagccctgctaattttgtgatagaactgaccgcttgttgttgctgttgttcaagccattgaagtgccattatcgttgaaaacgtaagtaaaaacggtagtttgcactttcaggggttggtttgtctaaagcaaccctttggcgttgtttagcttcaaggaacaaatgttgccaagacgatgtttcttcaccgttcaaggtttgcgtcacgcccgttttgtcgtaccaaaacagcttatagcttaactgcaagggttgttcacttttattgaacaccgcaagttcatctgattttgcgacaacctccgtgatctctgcgacattggcttcgatattaacaatcggcgttgtgcctgatggcagatagctcggcggatttgatccacaagcggtcagaaatacgctcaacagtgcaacaagagaaaaagcgtgtttcatcttatttcgccaacattttacctaacggctcaccgccaacaaggtgcatatggatatggaacacttcttgtcctccgtgtttattacagttcataatcaagcgatagccgtcttccgcaatgccttcttctttagcgattttcgcagcaacggtaaataaacgaccaagtgcttgttcatcttctgcagtaacgtgattaaccgttggaataaatttgtttggaataattaaaatgtgggttttcgcctgtggagcaatatcacggaatgcggtgacaagctcgtcttgatacacgattgccgcagggatttctttacggataattttgctgaaaatggtttcttcgtagttggttagcataatgtttccttatatcagtgttgtaagtggtaggattgtctaacttttttgagcaatttgcaaaaatttctgcaaatttgaccgcttatatttcatttagaggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggaaatttcaaaatgtgaacgaaatagtcgcgttatttttcgtgatatggtcattggcactacaaagggcacattannnntgcccgaaaataatcataggaacgccacgcttggcgttcatagaaacattaattttatcgcttgagttaggttgttttgctaataataagaatgttcaccgcgttgatgttcagtcacatctttcacgccaactaattcttctgggaaaagagcaagcaactgtttttcaatgccttcttttaaggtaacatctaccattgaacagccgttacaaccaccaccaaattgtaataccgcatatttatcttcagtgacttcaattaaggttacacgtccgccgtggcttgccaactgtggattgacttgggtttggatcacatagtctagacgttcaatgaaaggcgcatcatctgccacttttttcattttggcatttggggcttttaaagtgagctgtgaacccattggatcggtaacatagtcaatttcggcatcttcaaggaaaggaaggctgatttcgtcaataaatgcagaaaattgttcaaatttgatttcagtatccgtttcttctacggcattaacagggcagtaagatacaccacattcagcacttggtgtgccaggattaaccacaaaaatgcggatatttgtgccttcttcttgttgatcaagtaatttgcggaagtggttttgtgcaacgtctgagattgtaatgttcatcattttatccatttatgaaaactaaactgtttgctattttatccctatcctgattttttgactagcatcaaatttattaaaaatgaatttaggaagtgtctgtttttcattcattttgtcagggaataaagagtaaaatttgatgtatttcaaagtttcttaggctaaatgttaaaaaaatgtggtaaaactagcaataaaagtgtgttttcaggtagaataccttgtttatttttatcttggaaaaacaaggtaaagcccaatttgagaacttaatgtagcgaacaaatataagtgggggaatcaacgtttatgtttgcttttagctacgctcaatgtagcgattgcagtttctgcaatcattctttttaacccaactaaaagtagtgcaaacaatatgattacaattaaacaaggcttagatcttcctattgcagggaaacctgagcaagtaatccataacggtaataccgttaatgaagttgctgtgcttggcgaagaatatgtgggtatgcgcccttctatgaaggtgcgtgaaggtgatgtggtgaaaaaaggtcaggttctttttgaagataagaagaatgctggcctagttttcaccgctcctgcaagcggtacgattgttgcaatcaatcgcggtgagaaacgtgttcttcaatccgttgtgattaaagttgaaggtgatgaacaggtaactttcgagcgttataacgcttctgagttaagttcattaacagctgaccaagtgaagcaaaatttagttaattcgggtttatggactgcgttccgtactcgtccattcagtaaagttcctgcgttagatgcagtgccatcttctattttcgttaatgcgatggatacaaatccattagcgactgatcctgaagtggtattaaatgaacataaacaagattttgttgatggtttaacggtcttaagccgtttatttgatggacaaaaaacaatccatttatgtcgtgcaccagatagtaatatcccaacggctgaagtggctaatgtgaaagtaacttctttctctggtccacacccagcaggtttgagtggtacgcatattcactttatcgatcctgtttctgcgacgaaaagtgtatggtatttgaactatcaagatgtgattgctatcggtaaattatttacgacaggtgagttatacacaggtcgtgtgatctctttagcaggaccacaggtgaaacaacctcgcttagtgcgtacacaacttggtgcaaacctttctcaattaactgcaggtgaactagcagagggtgaaaaccgtgtgatttcaggctctgtgttaagcggtgcgaaagcgagcggtgttcacgattatttaggtcgttacgcattacaagtttctgtgattgcagaagggcgtgagcaagagttcttaggtatgattgccccatattcacacaaattctctattactcgtactgtgttaggtgcgtttagcaagaaattgtttaactttaccaccgctgttaatggtagtgagcgtgcaatggtgccaatcggctcttatgagcgtgtcatgccgttagatattttaccaacattgttgttgcgcgatttagcatctggcgatacggattctgctcaagcattaggttgcttagagttagatgaagaagatttagcgttatgtacctttgtctgcccaggtaaaaataactacgcaccaatgttgcgtgcagcgttagataagatcgagaaggaaggttaatcaaatggctttaaaagatcttttccataaaatggaaccggctttccagaaaggtggaaagtatgagaaattctatattctgtttgaagcagcttatacgattttctatacaccgggtacagtaactcaaaaagatgctcacgttcgtgatgggattgactctaaacgtatgatgttaatcgtatggttggcattgttcccagcaatgttctacggtatgtataacgtgggtgcgcaatcaatccttgcattaggcgtgggtgactttacccaaaacgtaactcaaaacgtggcaaatgactggcactttgcattagcaaatgcatttggcgtgttatcacaagatgctggcgtatttggcaaaatgttaatcggtgcgattttcttcctaccaatctacttaaccatttttgcagtaggtggtttctgggaagtgctattcgcaatggtgcgtaaacacgaaatcaatgaaggtttctttgttactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatccttttagcattaatcgttccaccaacattaccattatggcaagcagcgttagcaacaacctttggtgttgtggttgcaaaagaagtcttcggtggtgtaggtaaaaactttatgaacccagcgttagcaggtcgtgcgttcttattcttcgcatacccagcacaaatttcgggtgatttagtttggactgcagcagatggcttctcaggtgcaacagcactttctcaatgggcagtcggtggccaagctgcacttaaacacgttgcaacgggtgaaaccattacttggatggacgcattcttaggtaacattcctggttctatcggagaagtatcaactgtcgcattaatgatgggtgctgctattattgtatttgctcgcattgcatcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacggtatcttaattggagtaatgtgtgtgttgattcgtgtagcaaacccagcgtacccagaaggtatgatgttagcgatcttatttgctaacttgtttgctccaatcttcgactacttcgtggttcaggctaacatcaaacgtaggaaggcacgcaatggctaagtttaataaagatagcattggcggaacacttaccgtcgtgattttattaagtttaatctgttctcttatcgtggcaggttctgcggtgttgttaaaatcggcacaggaagaacaaaaagcccttgataaacagaaaaacattttaagtgttgctggtttattacctgaaggcacgaagaaaagcgaaattaaagatatttatgtgaaaaatatcgaatctaaaatcgttgatcttgcgacaggtgattatgttgaaggtgtagcgaattttgatgcaaaagcagctgcaaaagatccagctcaaagtatcgctatcaatccagcagacgataaagcaggtattagagttcgtgcaaaatatgcggaaatttaccttgtaaaagatgcaaacggacaagtaaatcaaatcgtgcttccattctacggaacaggtttatggtctgtaatgtatggctttgtctctgttgagccagatggcaatacaatcaaaggtatcacttactacgaaaacggtgaaacaccaggacttggtggtgaaattgaaaacaaacgttggcaacaaaatttcgtgggcaaaaaattacaaaatgctcagggtgaatccgcaattcgtattgcaaaaggtgcttcagctgataaagatcacggcattgatggcttatcaggtgcaacactcacctctaacggtgttgatggttcattcaaatactggtttggtgcgaacggctttggtccatatttagcgaaattaaaagcggggactaactaatggcaagcaataaacttaaagatctcttgttatcacctgttgtgaataacaacccgattgcattgcaaattctaggtatctgttctgcacttgcggtaacaacaaaactagaaactgcggtggtaatgggtattgcagtaagctttgtaataggcttttcaagtatgttcattgcgatgattcgtaactatatcccaaatagtattcgtatcattgtacaaatggcgattatcgcatcgcttgtaattctcgtggatcagttattgcgtgcttatgcttacgatctttctaaacagctctcggtatttgttggtttaattattactaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcgtaatgggacgtgcggaagcctttgcaatgaaatctggcccagtagaaagttttgttgatggtatcggtaacggtttaggctacggtgcaatccttgtgattgttgccttcattcgtgagttaatcggttcaggtaaactctttggtatgacggtattccaaactgttcaagatggcggttggtatcaagcaaatggtttattcctacttgcaccaagtgcgttcttcatcatcggcttcttaatttggggcttaagaacttggaaaccagagcaagtggagaaataagatggaacattatttaagtctatttgttaagtccatatttattgaaaatatggcactttctttcttccttggtatgtgtacattccttgcggtatctaagaaagtttcaacagcatttggtttaggtattgcggtaatcgttgtactaggtattgcagttccagctaaccaaattgtttacgagaacatcttaaaagatggtgcattagtggaaggggttgatttaactttccttaactttatcacctttatcggtgttatagctgcactagtgcaaattctcgaaatgattttggacaagtttttccctgcactgtatagtgcattaggtatcttcttaccacttattaccgtaaactgtgcgatcttcggtgctgtatcatttatggttcaacgcgaatataacttcgctgaatctgtggtatatggtatcggtgcaggtacaggctggatgttggcaattgtggcattagcaggtatcacagagaaaatgaaatactctgatgtaccagcaggattaaaaggtttaggtattacctttatttctgcaggcttaatggcacttggctttatgtctttctcaggcattaaattataaggagcgtatcgaatggataattttattttcggtatcgtggtatttactgcccttgtattaatgcttgcagtacttatccttgtagctaagtcaaaattagtggactcaggtgacatcacgatttctatcaatgatgatccagaaaaagcaattaccttgccagctggcggtaaattacttggtgctttagcaagtaaaggtatcttcgtttcatccgcgtgtggcggtggtggctcttgtggtcagtgtatcgttaaagtaaaaagcggtggtggcgagattcttccaactgagctttcacacatcacaaaacgtgaagcaaaagaaggttatcgtctagcgtgtcaagttaatgtgaaaagcagtatggaagtggagcttccagaagagatctttggtgtgaaaaaatgggaatgtactgttatctctaatgataacaaagcaaccttcatcaaagagcttaaacttcaaattccagaaggcgaagaagtaccattccgtgcaggtggctatattcagatcgaagcacctgctcacactgtgagatatgaagattacaaagcgttaatcgacgaagaatatcacgaagactggaacaaatttaacctatggcgttatgtgtctaaagtggacgagccaattatccgtgcgtactcaatggcttcatacccagaagagaaaggcattattatgcttaacgtgcgtattgcaactccgccaccaaataacccagatgtaccgccaggtcaaatgtcttcatatatttggtcactcaaaccaggtgataaagtcacaatttctggcccatttggtgagttcttcgctaaagatactgatgcagaaatggtcttcatcggtggtggtgcaggtatggccccaatgcgttcacacatttttgaccagttaaaacgtctgaagtctaaacgtaaaatgaccttctggtatggtgctcgttctaaacgtgaaatgttctatgtagaagatttcgacagcttacaagcagagaacgacaacttcaaatggtatgtggcgctttctgatccacaaccaggcgataactgggatggttacactggctttattcacaacgtgctttatgaaaactacttaaaagatcacgaagcaccagaagattgtgaatactatatgtgtggtccaccaattatgaatgcatctgtgatcaagatgttaaaagatcttggtgtagaagatgaaaacatcttattagatgatttcggtggctaatcagctataatcaagcggtcggatttgcaaaaaaatatgcggatctgaccgcttaagatttataggaaaataacaaaagatggaaacattagatatttcggcacttgaaaaagcctttgtttctctgcaaaaaacgattactcacttagataatcaagaatggtttaatgctcaagatccaattatccaagatacacttattgcaggagtaattcaaaaattcgagtttgtttatgaattatcaattaaaatgatgaagcgtcagctgaaaagtattgcttctaatgataccgatatagacagcacagaatttagagatattttacgtctatcagctcaatttggtttaattgataatcctgaagaatggttagatttccgtaaaatgcgaaatattacatcacatacttatgatgaaaataaggctctgcaagtatatcaaggcattagccatttcctagcgagtagccattatcttctctctcaacttcaaaaacgtagccaatgatagatttgaccgaacaacagttacaccttgttcaacgcattttagcgacacatttgccgaatgttcccgtatgggtatttggctcaagaattaaaggaacggcaaagcgattttccgatcttgaccttgcattgattaccgatacccccttaacaattcaccaacaagctcagcttgaactggctttttcagactcagatttgccatttaaagtagatttaattgactgggcaagttgtagtgacagcttcaaacaaattattttacagaagtatgaggttttgccttgtctttagcgattattctggtctataaagaaaaatggaaaagctgaaaatagcattaaaagaaatgcggtaacagtcgcatcttcagtacggtaactgcctaattgttggtaaagcaaataaggtaaggtgctaaagtcagggctaccaaaaaaggcaatcacggaaaaattgcctaaacttgccgacattgacagggcaaaagcattgataagcggtcggataagataatttttttccacaatccaccaacggcgaagccctgttaatcccaaactacgagccaatttatcgtgagaaaccaatgcttcccacattgctgaaaacaacaagcgatagatgtaaggcagtaacatcaaaccgttacaaattcccactaacaatagcagttgccaagtggttaattgcacattgatcagcagtaaaaatagcccaacggctaacataaatatcggtaaaatcaggggataagtactcacaccagcgagaatgctttgcttgattttctgtttatgataggcaagctggcgagtttcaagagcaatcagataagcaataccgatgacaaaacaagatgcgataaggcttaataatagtgaataacttgccgattgccacaatgttggcgaaaagagccgttgccaaaagtttgatactgaaatggcggtccaaactacatttgcaagcggtaataaaatggtaaaaattgccccgaaaagcaccgcttgtagtagccatttttccttacctttaggctgtgccgtccagatatcaatcgatacagactgtgttttcactcgctgaaaattaaagcgtgtcacccaatccattatcagttgtaagccaatccccacaaggatttgcaccataattaacatcaccgctttcgcaaaatcaaactcaaaagtcaccgcttggtaaatcgccacttcaagcgtactgtatttaggccccccccctaacattaatacaattgggaagctggtaaaacagagcaggaaaaccgtcgcataggcatagggcaaaatgccttttaatatcggcaattcaacaatcctaaagtagtgccacccagacagattgagctggttcgccagttggtgctgatgtgttggaataagatgtagcccttcaaagcaatactttgcgacaaggggaatgttcaaaaacagatgagctaacacaatcccttgtaaaccgtacaaggaaaaatcccacgacaatcccaccgcttgaacgagatgggctatccaacctgaatttccccaaaccccgattaatgcaaaaatcaccactaacgaaggcagagcccacgcaaaggaaatcagcttatagagcaaggttttgctccgaaaacgtaggtagaaaaagctacgagccacaaaacccaaggtgctgtattttaaaatttgccacgtttcttgccacgaccaaaaggtttcatcggcactatgttcaaataatgcccagaaactgaacgtatagagtgagagcaagccaacatagcttgcccaagcggaaaattgggtgagttttcgggacatttatatctcgttgataatattctgctgtcatataagtaggcaggctattttaacatgaataaaatttttcttaactagaagataatcaatcagttagaaaatataagagagaaagattgcctaacaaagctcatttaatcaccattcaatttttgcaatttgatttttttcaaacaaattgcagaatcctctagtaaaacattcattctttttatacatttcacatacatcttttatttatatctatcttattgttttaataagaaaaattatcatttgcagtgagttatgtgtgaggaggctcgcgtgaaaaaagtcagtaaaatgttaaaaaacagccttgttgcgacaatggctatgttggggtgtttccaagctgcgtgggcaggggaagccaaagagtttgaaggcccaaaacctgatgtgaaaattgaatcagctaaccataaatttgctgaactttatcctttacagtaccaatcttgggctgcaacagccgaatctaaagaagtaacaagtgctttagaagaagatcctcgtttagtggttttgtggacaggttatgcgttctcaaaagattacaataaacctcgtggtcacttctatgcggttactgatgtgcgtaatattttgcgtactggtgcgccaatggacgaaaattctggtcctcagcctatggcgtgctgggcgtgtaaaagtccagatgtgccacgtatgatcgcagaaaaaggcgaagttggttattttgatgcaaaatgggctaaatatggttcagaaattgtcaatcctattggttgtgcggactgccacgataccacttcacaagaatttaaagatggcaaagcggcactgcgtgttgctcgcccacacgttttgcgtgcgttagaagttatcggttggaaattcgatacactggataaacacggaaaacgtgcagcagtatgttctaactgtcacgttgaatactattttgcaggcaaagaaaaagcggtgacgttcccttgggataaaggtgtagatgttgatagcattgaaaaatactttgatgaaatcaaatttactgactgggttcacggcttatcaaaagctccaatgttaaaagcacaacacccagactttgaaacttgggcgttaggcacacacggtaaaaatggcgtaacctgtatcgactgccatatgccaaaagtagaaactaaagatggtaaagtctataccgatcacaaaatcggcaatccgtttgataactttgagtatacttgtaaaacttgtcacgaacaaagcaaagagagcttacaagctcgcgtgaaagagcataaaaaacagatcaaagacgtaatgatccgtttggaagatcagcttgttaaagcacactttgaagcgaaaagagcttgggaagcgggtgcaactgaagaagaaatgaaagacgcgttgcaagcaattcgtcacgcacaatggcgttgggactactcagcggcaggccacggcggtcatatgcacgcacctgatgtaattcttcacgttatcggaacaggcttagatcgtgcagcagatgctcgtactaaacttgcagttatcttaacgaaacacggcgtacaaactccgattgagttccctgatatttcaacgaaagcgaaagcacaaaaagttgtaggtatcgactttgataaagagaaagcagcgaaagaagaattcttacgcaccgtagtaccacaatgggaaaaagaagcgaaagagaaaggcttattacctgcggacgcaaaataatttgctaagtcgaggctactatgaaacatattttctcaatgattaagctacaagcggttgcattactgagtttctttgcaatatcttctactgtgttggcagaaatgccagcacaaccacagccaatttggaccaatccgttggataatgtagatggtgcaactattgctaaagactctcgtcgtgatccgaatacttattgtgtgaattgtcacggacatttatctgccttcaaacacacaggtaagcactttcaaaaagatacggttagtccgaataacggcaaaccgcttaactgtgtaagttgtcacggtaatatttctgaaaatcaccgtaagggtgtgaaagacgtaatgcgtttcaatgctcatggtaaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtaaagcgagaaatccagccttagagcgttcagtcgaagagcaaaatcaagtctgttttgcttgccatagccctgacaaattgcgtgaaaaattctgggcgcacgacactcacgctaataaaattgcgtgtgtaaactgccacaaactacacccagaaaaagaaccaatgaaaggcattgagtctaaacagcgtgtaaaactctgtgtggattgtcacacagaagtacacaaaggtacgtttaaaaaagcggaagctaaggatcaaaaatgagttgttcccgtcgagatttcatctcaggggcgggagcagtgattgccgtggcaggcacaacggggcttgccacaagtcagctctcccttgcgactgagaaagaaagtaaaaccattcgctatgcgatgttgcacgatgagcaagcctgtatcggttgtactgcttgtatggacgcttgtcgtgaaacaaacaaagtgccagaaggggtatcccgtttagaaattattcgtagccaaccttatggcgaatttccaaacgtaaaatatgaatttttccgtcaatcttgccaacattgtagcaatgctccttgtgtgagtgtttgcccaacaggtgcgtctttcattgataaagcaacaggcatcgttgatgttaatccagatctctgtgttggttgtgcttactgcattgcggtctgcccatatcgtgttcgctatattgagccagtgaagaaaactgccgataaatgtaacttctgtcgagatacaaatcttgcacaaggtaaacagcctgcttgtgtagaaagctgtccaaccaaagcactaacattcggtgacttaaacgatccgaatagcgatatttcccgtttaatcaaagaaaaaccaacttatcgcacaaaaatggaattaggcacagaaccaaatctttaccatattaagaaaggggaggcaaaataatgaacgactatgttccattccaaaccccaaatcttgtatgggattcaaccattgcgatctatctctttttacttgggatatctgcgggttcaaccttgttagcagtgctatataagcgtaaagcgaatttagctgatccaagccaaagttggattattcgcacaatggcaataatgtcaccgcttgcaaccatcatcggtttaaccttattgattttccacttggctcgtccgtggacattctggtatctgatgttcaactaccagtttgattcggtaatgtcgatgggagtaatgctattccaagtctttatggcggtattagtcgtttggctggcgatcatctttaagaactggttaagtggctttgggtttattccgaaatttgcttttggattaattgatattgcagcgaaattcacctcgttgattgaaatcctgttgatcttactatcccttgcacttggggcttatacgggtttcttattatctgaattaatcagctatccaatgttaaataaccctgtcttgccagtcttattcttggcttcaggaacttcatctggtattgcggcacttcttgtggcgatcttggtggttggcaaagtcgcaacggatagtcacgaagtacatttcttgcacaagtttgaaaagccagttgcattcattgaaatgttacttttagcaggcttctttgcttacctttatgctaaaggtggacaaagtgcagtggcagcggataacgctttaaccttttcaggctactggggcaaaatgttctgggtaggcgttgtagctatcggtttagttattccaatgttacttaacattgtttcaccagcaaaagtgaaacaccaaaaaggctttatccttttccttgcagttttaggtttaatcggtgttctctgtttacgttactttgttctttatgcagggcaaatgacgattgcttaatctcctcacaagcgggcagatcttgcaaatttatcgcaaaatctgcccgcttgctttttttcaatatcgataaaatgttaatatgcgttcctatccaaaaggagctaatatgaacaaaccagtcaaaaatgaaatgcttattgtgattgctaatggcttatggcgtttattagggaatatcgtcaaaacgttaagctatccgtttcacgccttatttccgaaaaaacgttttaccattccagaatttagtccagctaaaagcgtatcagctaaatcaacaaaaattactaaggtcatctggcagactaattacagcaacaaagtaaccttaccagtgtattgtaattatttagttaatcgtatgttgtcacgagattatgactaccgctatgttagcactgaagaacgggcggaatatatcaaagctaatgcagatgaacgtacttttaatgcgtatagtaaacttacggatggggctgcgcaggcagatttctggcgtattttcaccttatataatgaaggtggtatctatatggatattgatgggcatttagtttggaatctcgcttcaattattggtgaaaatgatagtgaagttgttatcactcgccgagacaaatacaccaatttctttttagccagtgaaaagggaaatgcgtttttgaaagaaacgttagagattattgtcgataatattgagcaacgtcggattgatggtggcgtattttctttaactggaccaatcaccttaaatatggcattggaaggaaaaacggttaatcgtcgccgagataaaatcacttgcgtgcaggggacttttactaacgaatattttcagtatatggataaaaagcgtagtaaatggaatcacgctaaaaatgaagatttattgaagtaatctgatattaagaggcatagtaaacaaaagttactatgccatattggtgtcttaattgattattgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtgtaatagacaaaagaaatatagatatatatctaaagacattatggggaatcaaacaattcctttgcttttaatagtaacagtagggcagttaaatctccaaagtttactacgaatgccgattgttcttgtactttgggtttggcatgtagtgcaacgcctaaactggcatgtttaagcatcagtagatcattggctccatctcctactgtaatccattgctcttgtggaataccaaacttgtgagctagagccattaacgtatctgctttacattgagcatctactactttgccaagtatttgacctgttagtttgccatcaataacttcaagcctatttgacacagaataatctagatcaaaagactgtctgaggtagtctgcaaaatagtcaaatcctcctgaagcaatagctatcttccaaccatattgtttcagacttttaattaataattcaaaaccatccataagtggtaactgttcacgaacttgttgtaagatactttctggtgcattttcaagtgctgcaacacgctgacgtaaactttcttcaaaatcaagttctccacgcatagctcttgctgtaatagatgaaacaatctctccttttcctgctaatttagcaatctcatcaatacactcaattttaatcgcagtagaatccatatccattaaaagtaaaccttcttttttaatgcaaggaagaatatctaacctactaaaatcagcttgtatggtttgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttgtatggtttgagccttctctcgtagagaatctgtcaaatctcctctaaaaaaagcaacatggtaatccaaatactccacttgttttacaaaaatagtagaacttatgtgagtgaagtgggcaatctgttcagctgtaagctgcttactgtaaataaaaaagatatgtgacatgattctttcaaacctttatagtgagttttactaactttagcaaaattacgtgttagaatcatcttctaattttatggggacaattatgtatatttctcgtgagcaactaataaagagtagcattattgctgtgatcatggcaatttgtttaatgattgtgtggataatactgactggtataaaccatttcaaagtaggttcacagctggctgggattaaccaagtaacaaatctttcccatttacttgtacgacaacaggcaaaattgttttccttgatgttagtaaaaaacgcaaaaaatgatgaattagttgaagcattagatgtttttgctaaagaagcgtttgtcattgatgctaatttgtattcgccatcaggaaatttagttgcacatagtagcaatgcgattgaatttaacccgagagtaaacgacaagatacaacaagagccggcacttacccaacaaattgtagagcctatttttgcacaggatgacttaattgggtttttacgagtaacttttgactctcaatatgggcaaacaacacaacataaagtaaatgaattatttcatttgctttatggtgagttgattattttatttatgtctggagggctatttgttagttgtttctattattttttacagctaaatacaacaaaaacagtttcgtcaaactttatacctattgaattaaaacgtcaaactcaacgttttcactctcgaagaagagcttttcgccgtaaatgattgtaattcaggtaagggagagtataatacctcgcattttgccaatatggcatatttataatgacacaacttaaatttaatttgaagaggaataaatggctaaagaagattgcattgaaatgcaaggtacaattttagaaaccttacctaatactatgtttcgagtagaactagaaaatgggcatgttgtaacagcccatatttcaggaaaaatgcgtaaaaactatattcggattctaactggagataaagtcaccgttgaaatgaccccatacgatttaagtaaggggcgaattattttccgtgcaagataattgaggtatacataaaaatggaagcgtctagctcccatttttatggtcagctctcggttattttttagtaaagtcaggtcaatcttttgagcaaacgtcgcttaactcagaatcaacaacgtcggattcaaactaaccatcacaaaaagatcaacaaagctgaatttgaatggcaagatgaaatgttgggggaagtccagcaaggtcttgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttactcgccacgctaaacacgcagatgtagaaaccgcaagtggtgagattttccgttgtaatttacgccgaacattaaaaaatgtggtggtaggcgatgtagtgtcgtggcgtttgggaagtgagcaattgcaagggattagcggtgtgattgaagctgttcacccacgccaaaatgagctaactcgtcctgactattacgacggtattaaagtaatggcgtcaaatatcgatcaaattatcattgtgtccgctgtgttgccacagctttcactgaatattatcgaccgctatttagtgatttgtgagaatgccagcattcctgccttaattgtgttgaataaaattgatttattgagtgaacaagagcgaaaagaagtgcaacaacagctggcgatctatgaaaagattggctaccagacactctgtttatccgcagacacaggcgagaatatgcaggcgttgaatgcttatttagcgaaaggtacatctattttcgtcgggcagtcaggtgttggaaaatcaagtctaatcaatcaattattgcccgatgtaaatgctcaaacgggggcggtcagcgatatttcaggcttagggcaacataccacaacggcttcacgtttataccacttatctcaaggtggaaatttaatcgactcgccggggattcgcgaatttggcttatggcatttagaagccgagcagattacacaaggttatcgggattttgcttcggtattaggtacttgcaaattccgtgattgtaaacataaagatgacccaggctgtgcattaaaagaagcagtagagcaggggaaaatcgatccgatacgttttgataactatcacaggctcttagaaagtcgccaagaaagtaaaagtcagcggtattttagaaaagaataataaaatcaacgggttgctagataaaaatagcaaccctttctcatttgtaatacttattgattctcatatttatcagcttgttgattatcatctagccgagttattgagaatcatttttatttgttgacaggttaaattttatctataaaatgctgcctgaaaaccccataatttatataaggagtctaactatgaaaaaattagcagcactacttggtatgctcttttttgtcagtaatccacttgctgcccagcagtttaaagtggtcaccacattcactgtgattcaagacattgctcaaaatgtcgcaggggataaggcggtggtcgaatcgatcaccaaaccaggtgcggaaatccacgattatcaaccaacgccacaggatattgtaaaagcacaatctgcggatttggtgttgtggaacggtatgaaccttgaaagctggtttgagcgtttctttgctcaagtgaaagataaacctgcggttgtagtaacggaaggtattgaaccgatttcaatctatgaagggccttacaaagataaaccaaacccacacgcttggatgtccacgaaaaatgcgttgatttatattgaaaacattcgccaagccttggtgaaatacgatccggcaaatgcagaagcctataatgcgaatgcaaaggcctatgccgataagatcgttgccttagatcagccgttgcgtgagcgtttggcaaaagtgcctgaagcacaacgttggttagtgacaagcgaaggggcgtttagctatcttgctagagattatggcttcaaagagttatatctttgggcgattaaccaagatgaacaaggcacgccaaaacagatccgcaaagtgatcgaccaagtgcgtaaacatcaaattccagtggtatttagcgaaagtaccatttcagataaaccagctaaacaagtggcaaaagagagtaaagcacgctatggcggtgtgttatatgtggactctctctcaacaaaagatggcaaagtaccaacctatattgatttactcaatgtgacggtaagtacaattgttgctggatttgaaaaataaaacgatttgggcgaactgctttggttcgccctgcatttacaaaataggattacctaacaaatatgaacattcccctgagttctctttctgtttccgatgtcaccgttcgttatagcaacggacacacggcaattcacgatgttacttttcgccttgacggtggcacaatctgtgcattacttggggtgaacggcagtggcaaatcaaccttatttaaaagcattatgggcttagtccagccaaagggaaatattgagctatgcggactgcctgtcaatcaagccttaaaacgcaatcttgttgcttatgtgccacaaagtgaagaagtggactggcaatttcccgtatccgtttatgatgtggtaatgatggggcgttatggctatatgaattttctgcgtatcccttctgctgtggataagcaaaaagttgctgaagcaatggagcgggtcaatattgctcatcttgcggatcgtcaaatcggtgagctttcagggggacagaaaaaacgagtatttttggctcgttcgcttgcacaagagagcaaaattatcttacttgacgaacctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactggcgtggacgtaaataccgaaaatgcgatcatcgatctactcaaacagcttcgggatagcggtcacttaatccttgtttctacccataatttagccgccgtaccaagtttttgcgatcaagcggtaatgattaatcgcacagtgttagcaacaggatctatcgaaacgacattcacccccgaaaatcttggacgagtatttggcggtgtcttgcgttatcagcagttactcggagaccataaggaataatcaatgcttgagttactgctagaacctttttcctacgattatatgtttaaagcgattgtagtaagcggtgcaatcggggctgtttgtgcttttttgtctgcctatttaatgctcaaaggctggtcgctgattggagatgccttatcgcacgccgtcgtccctggtgttgcattagcttatgccttgtccttaccttatgctgtcggggctttcttttcgggatttcttgccactattgctatcttagcggttaaatccgtcacaaaattgcgagaagatgcggtaattggttttatttttaccaccttttttgccttaggtttattgattatttcaatcaatccaacgtccgttaatgtgcaatccatcattctcggtaatatcttaggtattgccgatgaagatatgctacaagtggtgattattttatcggtgtcactcttttttctagtgatttactggaaagatttattgcttgtcttttttgatgaaattcaagctaaagccgtaggcatttcgccgatgcgacttaaagtgctgttttttagcctactcagtgcttgtatcgttgcagcattacaaagtgtcggtgcaattttagtgatcgcaatggttgtcaccccaggggcaacggcgtatttattaacggataaattcggcaaattgttgattatcgcaatttcactgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttccttttatacaacaagccttagttatcggtattgtggttgccataatctgtgctgtgttgtcctgctatttagtgctaaaaggttggtcgctaatgggcgatgccatctcacacgccgtattaccagggattgtgattgcctatctgcttgccattccattagcaatcggggcttttgtttcgggtattttttgtgccgttgcagtgggctatctcaaagaaaatagtcgcattaaagaagatacggtaatggggatcgtcttttcgggaatgtttgcgttaggtttggtgatgtttgccaaagtcgaaaccgatcaacatctaatgcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgcaccgttggctttaatatcaaagtgttacattacagcttactggtgctattggcattagtgattattagtgcaatgcaagtggttggcgtgattttagtggtggcaatgctgattaccccagggatcacaggctacacgcttgccaaacgctttgaccgaatgttgctaatcgccatcttgactgcagtaaatagtgctttctggggcgtgtttttaagtttccatttcgatgtcgccacaggaccttgtattgtgttgttgcaagcggtgggatttttgggggcgttaggaatcaataaatttaaagtaataggcaaaaaaatttattaaagttatatttttctttaatctatgttaagtccctagatagcaaatcatctagggactttatctttattaattaactaattaaccacttctcaactaattctggcgttgtttctttgtgtcgccacatactgcctaattctggctcagggaatttggtatggttatagccaacaaattcacggaaatcaaatacggcgtgtggataatcatttaacagcaaaaatgcctcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaaaaatgcctcgtagccatcttctgaccagcagatctgaaaacggcgaggctcttttagggtttcgggtttgacatcgctgacacgatagacaaataagctatcgaccacaggttgcgcttcttgatgtaaatccattgcatagaaataacctgtttcgccatcatcttcaaacattaccactaaatgttcgtgtttaatggaatgtgtgctgttgcgatagggcgtgccgagcgtaatataatcgtttaggactgaatataacataaggtttcctcttttaattttggcgacattttaacatattctagctgaggaatgcttgggctatctgctgggcgttagaaagtcttttcaaaagcaagagtaatattatgcattttataggaataaagcgtatccaaattgcttttctgtttccgccattccaaattcaatttaggtgtaatgccccataaatgccaatctcgtttccaaacttgtgcgaaaactgaataaatctgatcttggcgagttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgagtggcaagatgccgcccaatatcgcttgatctttaaattggcgatgcgtaaaagagaaatttaatttagttgaaatcccaaaagcgtattcttgcaaccaacctaaacgtaaattctgaatatctgagctgtattgttactcttgtaagcgttgctgagaaaaggcggcactgacataaaaaaatctgttcggggtttcgataccaaattaacgttgttgatgccgtccgaatatgcctggcttgaggattatctttgaaaaaacggcgtttttcatattcaagtacggtttgattttgccaattttgtgaaagccaaaaactgtaactgatttccgctccattggaccaatgaaacgaatctccaccataccaacgtttttcactttatcaaactgcactcttgctgcgctatcttgtcgatcggcaaagagtacttttgccaattccattcgaattgaatttagttcaggtcgttcgctcaatatttttcggtaaatacgaatagcaacgccatagttctgctgtaaaactgatagtttggcttctgcataagactttaatgtcaaatcttgctgaggctgctgttgatattggtaaagtaaagattggatttgaccgctattattttggtaaatagcttgtttcaattgctcttcaagtgttgttgcggaagcaaaaacaatattagaacaacataaggcgagtaaaaagaaagaacgcataagaatggtaaaagttatattcaaacctagcacgcaaatgcgaactaggtttaactgctcaaagaattagtaacgaataccaccgaatgaagtatcgtagctgttatcgccactgaaagttgcaatacctgctgcttcttttgcaccattgccaaataagccaccttcataagtaccttctcgtaatagagtggttgctttgccgctgaaagtggtaccgtttaattgggttttgtgcaaggtaatatcttgcacacgtccatcggttaataggctaaattcaactttgtcatctactgtttttttgatcgaaatcatggcacagcttcctgcagaaatgacagataaattaattggacagcgtattcagcaaaagagaaaggaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaaaggaatttggttattcggcagaaaagttgtcggagtgtatcaatttatctcagcaacaactttcacgctatgaacgtggtgcaagcaaaatcaacgttaatcacttgattgatatcgctattttctttaaaacacctattaattggtttttccaagattgtattccagcagaatttactgaaaaggaattaaaagagatagaaataaaccaaaaatgggataacttgtcttctattcaaaaagaagcatttattacatttcttgaaacattaaaataattctgcgagagcttaataatattaaacctatttagaaaataaacattagcaacaattttgtctactatgctttttaacttaagaaatataaaaggctcttataaattttttccaatattacataatccactgattaccagtggattatgaattgaattacacggtatatttaaaactcttttaatagatttacacttataatttcaagcagccttgatgtttccaaacaattctctcgccctttaataaagaaacgagaagtcatcgctttttcgccatcgttgaggaaaatctcaacaacagaacggtcaaagaagatctcgacattttccaatttttcgacttcgcaatagcgttgttcaccaaattgcttcattagatctgtttgatctgttgctgaacgatctagggtaactcgcccattttcataacggaaagtcagattttgcccctgctcgttatcaaagaaacggattacaagcggttgattttccacattaaattgcaaatatgcggtgtctaggttttctacttccgtaatcccattcacacttaacgacactttatcctgcaattgtgcgtaaatctctttgactggctgttggaaaattttgctctgtttaacggaaagctggcgaggcattgtcagcattgagtgccatttatacttatccgttggataagtcaaatccggcaaaccaacccagccgtataaaatcccttctgcattctggacagtctgcggtgcatagaaatcaaagccataatctagctcttcaatatgttctgctgtcagcgttgagccagcgaattgacctaacgcataagtggcgtggtaattattttggaaacgtgtcgcttcacgcaatttaccctgtggcgaccagacgaacagatctttatccgccaatttgaacaaatcggggcattcccacataaatacgttgctattatcaaaatcattaatcgcaatttcagagagtaaacgtggggtagcttctaggttatccatttcatagagcaagcctgtgcctgttaggttttcacgttgagcgcctaatacaaaacggattttgccttctgcggtaacaaaaggttttggatcacgaacgtgttccgtatagccttgtggtgcttgatcgataatacaacgcttttcaagcaatttgcccgatttatcaaaaatagcaatattttgatgtggcacacgctgattatcgctcgctcgacgcgtattgcccgtatagaacgcaacaatcttatcttgccataaaatcgccccacccgaataacaaccgtgggattcaaacatctcatcaggaataagcggatcagcttcagtaaatgtttggaaatcctttgtcatcagatgtttccaatgtttcattccgtgcaacgcatcgtaaggaaaccattgataaaaaatatgatatttttcaccgtcaaagattaagccatttggatcgttgagcaatcccgttggtggtgcgagatggtaggttgggcggaaatcctgatcctgttcaaccgcctgacgaactgcatcgagttcaccaacttcttgagcgtgcaggcttttgtatttaccttgattgaaaatgtgcatagtattttcctcctgtgagggtttagttccttgtacaacctgataacatcgtctacattcacccccaaagatgttatttacaacattcttttggaaataaagacagataaatgaagcaaatgccatatcacacacagaggatttgcgatgcccaagaaatgaaaatctgtcactcagtgacatgtacaactctgtaaatgtaagcgatgtatggagtatacactgataagtgtgcagcttttttacagctaatgcaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccaactttttcacacacaaagtgaagaagagaaaaatagatgttgtacaagaattaagaatagatatgctgttttttctatttttgtatagattccacctctggggtattggctcagttctaccaagtggcaattaattcgggcgttgcaccgcttgtgatctttatgggcgttggggcaatgacggattttgggcctttactcgctaacccgaaaacattgctcttgggtgcggcagctcaatttggtatctttgcaacggtattaggagcggtgggtttaaactggttgggtgtgattgacttcactttaccacaagcagctgctatcgggattattggtggggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagatggtgcagttacgaaatgttagcacacgtgagaaagtactgtttccgattgtgttgttgattttggttgcattattgcttcctgacgctgctccgttgttaggtatgttctgttttggtaacttaatgcgagtgagtggcgtagtcgaaagattaagcgatgttgctcaaaatgcgttaatcaatacggtcacgattttccttggcttatctgttggctctaaattaattgccgataaatttctacaaccacaaaccttaggcattttagcattagggattatcgcctttggtattggtaccgcaagcggtgtgattatggcaaaaataatgaaccgttttagcaagaccccgattaatccgttgattggttcagcaggtgtatctgcagtgcctatggctgctcgtgtatcaaataaattgggacttgagacagataaacagaacttcctattaatgcacgcaatgggtccaaacgttgctggggtaataggttcagcgattgccgctggggtgatgttgaaatatattgcggtgttgcagtaaattatttttcgttgttggggtattcatttaataccccaattttttattcatttttacaaaaaatccctcaaattttaccacttgtagtagaatagcgtttatttaaatctattgaggatatttatggattaccctatttgccctgcttgtaaaagcgaaaatacttaccacgattcaattcaatttgtttgccctgattgcggaaacgaatggactggtaatgaagttgaaatcgatgaagatcaattgatcgtaaaggatagcaatggaaacttacttgctgacggtgacgatgttatcttaattaaagacctaaaattgaaaggatcctcagaagtactgaaaaaaggaactaaatataaagggattcgtctagtcgctggtgatcacaatgtagattgtggaaaacttttattgaaatcagaatttttgaaaagagcttagattttaacttagtttataccgtaataggataactatagtaatatggaaagaaaatgtgataacggagacgatattatgaaaaatattgtcgtcatgatttcgggcaatggctcaaatttacaagctattattgatgccattgatactggaaaaatcaacggcagaatttgtgctgttatatctaataaagccaccgcttacggtttagaaagagccaaacaagcggggatttctacctttatttttaccaaaaaagacttttcagataatctggcaatggataatgccattgcagaacaaattgaagccctgcaagccgatttaattgtcttagctggctatatgaaaattcttacccctgaatttaccgctcgttttacaggtaaaattcttaatattcatccatcacttttacctaaatatgcaggtttaaacccacatcaacgagcaatggaggctggtgatagcgaacacggtacgaccattcactttgtcaatgaagaagtggatggcggtgcgattattttacaagcaaaagtgccgatttatcctgatgatgaattagatgatgtgattgagcgtgtttatgaacaagaacatcgctgttatccccttgtggtgcaatggttctgtgacgatagattaaaattaattgaaggcaaagcctatttggataatcaactgttatcgccacagggttatgcgattgacgattaatctgcttgtagaacatatttcagccctttactctcaaagggctttttatcataaaaaaaactaatccgaaacggcaatttatatcgccccaatccattttggaaatatgatctagatcacattttttatgtcagcttctcgttatgatctcttcacaaatatgtaacatataaaaggaaagcaataatgagcaatatgcgtattgaagtcgatctattaggtgaacgtgaagtttctaatgatgtttactggggtatccatactctacgtgccgtagagaattttaatatttctaaaaataccatttctgatgtacctgagtttgtgcgtggtatggtgatggtgaaaaaggcgactgcacttgctaatggcgagttaggggcaattccgaagaaaattgcaaaagcgattgtacaagcctgtgatgagattttggtgaatggtcgttgtatggatcagttcccatctgatgtgtatcaagggggagcgggtacttcggtgaatatgaataccaatgaagtagtggcaaacttagcactggaattattggggcataaaaaaggtgaataccatattatcaacccaatggaccacgttaatgcaagccaatcgaccaatgacgcttacccaacggggttccgtattgccgtttataacagcattatgcaattgattagtaaagtactttacttacaacacggctttgaaaataaagctgatgagtttgccaatatcttaaaaatgggacgcacccagttgcaagacgctgtgccaatgactgttgggcaagagttcaaagcgttttctgtgttgttagatgaagaagtgaaaaacttaaaacgtaccgcagagttgttgcttgaagtaaacttaggagcaacggcaatcggtacaggtttgaatacgccagaaggttacgcaccgcttgcagtgaaataccttgcggaagtcacccagttaccttgcaccttatctgaacacttaatcgaagcgacatctgactgtggtgcttatgtgatggttcacggggcgttaaaacgtacggcggtgaaattgtctaaaatttgtaacgacttgcgtttgctttcatcaggcccgcgtgcaggcttaaatgaaatcaacttgcctgaattgcaagcaggttcttccattatgccagcgaaagtaaaccctgttgtgccagaagtggtgaatcaagtatgcttcaaaattatcggtaacgatacttgtattacctttgctgcggaagcagggcaattgcaattaaatgtgatggagcctgttatcggacaagcgatgtttgagtctatcgacatcttggcaaatgcttgtgtgaacttgcgtgataaatgtattgacggtatcacggtgaacaaagagatttgtgaaggttatgtatttaactctatcggtattgtgacctatctcaatccgtttatcggacaccacgaaggcgatattgttggtaaaatctgtgcaaccacaggcagaagcgtgcgtgaagtggtgttagagcgtggcttgctgacagaagaacagttagacgatattttatcggtcgaaaacttgatgaacccgaaatataaagcaaaacgttttacggaagatgaataattttcgttataatgttacacaatgccaaataattcccttgaaatttaagaataacgccctatttagtagggcgttattttttgtgataaacataaaaggaaaattatgagtacaaaccaagaaacccgtggctttcagtcggaagtcaaacaactgcttcaattaatgatccactcactctattctaataaagagatctttttgcgtgagttaatttccaatgcgtcggacgctgctgataaattgcgtttcaaagctctttctcaacccgaactttatgagggcgacggtgaattgcgtgtgcgtatcagtattgatgaagccttaggcacaatcactatcagcgacaacggtatcggtatgagccgtgagcaagtgatcgatcatctcggcaccattgctaaatcaggcaccaaagagtttttaaatgcactcggttcagaccaagcgaaagacagccaattaatcgggcaattcggggttggcttctactcctcttttatcgttgctgataaagtgaccgttcgcactcgagccgcaggcagtgatgcaagtcaaggcgtattgtgggaatcggcaggcgaaggcgattacaccgttgccgatattgaaaaagcaggacgtggtacggacgtgattttacacttgcgtgatgatgaaaaagagtttttaagcgagtggcgtttgcgtgacattatcggtaaatactctgaccatatcggtttagcggtggaaattcaaaccaaagagtatggcgatgaaggcaaagaaactggcaccaaatgggaaaaaattaacaaagctcaagcactctggacacgctctaaaaatgagatttctgatgaagaatacaaagagttctacaaacatatcagccacgattttgccgatccgttaatttggtcgcacaataaagttgaaggtaaacaagaatataccagcctactttatgtaccaagtaaagccccttgggatctgttccagcgtgaacaaaaacacggcttaaaactctatgtgcaacgtgtgtttattatggacgatgtggaagtctttatgccgaattatcttcgctttatgcgtgggttgttggacaccaacgacttaccactgaatgtcagccgtgaaattttgcaagagaacaaagtcacccaatcactccgcacagctctaactaaacgttccttacaaatgttggaaaaactggcgaaagacaacattgaacaatatcaacaattttggaatgcgttcggtttagtcttgaaagaaggtgtaggggaagatttcgcaaataaaaaccaagtggcagccttagttcgctttgcttcaacgcatactgacagtagcgaacaagcggtcagtttgagcgattatattgcaagaatgaaagaaggtcagaaagcgatttacttcttaactgccgacagctatcaagcagcgaaaaacagcccacacttagagctgttcaacaaaaaaggcattgaagtcttactactttctgaccgcattgatgaatggtttatcagccatttaaccgaatttgacggcaagccattacaaagtattactaaatcagatttagatttaggtgatcttgctgacaaagaggaagaagaaacccaaaaagtacaagaagctgaatttgcgagcttcttagagagagccaaaggctatttaggcgagcgtgtcaaaaaagtggtcttaactcaccgcttgaccgacacagcagccgttgtttcaactgacagcgatgaaatgaccacgcaaatggcaaaactattcgctgcaatgggacaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaatgggacaacaagcccctgaagtgaaatatacctttgagttaaaccctgaacattcaatggtaaaacgtatagctgatattgctgacgaagcagaatttaacgactggattgaactcttgtttgaacaagcgttactcgctgaacgtggcacattggaaaatccaacggcgtttattaaacggatgaataaattgctaggagcataaagttaaaggggcggctgtcgcccctttatttattgaaataaaccgaagcgaatattgtttaaaagtggtgtaatagacaaattggcatagcagacaaaagggggtaatagacaaataaagaaacattgtatacaaaataatacccaaatttatacaactgttgttacaggtttaagtcggtcttatatccttaattattgtataatgccataaacaagttatattcaaactgtgttaaaggtcctctttgggttttactctctaattctcctgttgaataaccattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttgaatattaccattaaattgaatcccaatacgttttaaattagctttaataacattccctccatagcttgtagtgtcttgcacggcaaaactcaatccaacaggtttagtttgtttagataagcaacctttaatgtagtagcgattgttatcatgtacaacgacatcaagttcacagaaatttgcttcagatttgtcagcaacataggcactactaaatacttgtactggataggcactaggaacgctaattttaatcagacttccaatagattgatttgcatctaaattcacataaaaacaattttgatcgatatttactgcagaggagggagcactaaaacattggcttagatcattccatacccagccgatggctttatcatgactagcaaatacagatgtatctatgatcaaattgccactaatcttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatgccctgttcttttaattgtgaaattagttgaaataactgaccgctagttaaagtaggatctccagtaaatttggcgattaaatctccctctagcaccccattctcaattataccattcgtcaagagtgctgtttgaaatttaaaatctgtgttcagcatgatcttagaggctaaagcagtaaatactttttgagtactagctggcaacataaacagatcactttgataatcgacaacaatttgatcggtagataaatttttagcgataacactgattgatgtacctttaggtaaatgagagatgaacggtgtaatatcgacctctgctgaagtactataaggcatataaaaaaaaagagttaaaagtaaaattctaagttgtttgagcgaaaatgaaatcatagtaaggttgctatttttataaagaaaatgaataatagtcgactaatactagattatatctctttttctgccaagacattctctaattttggtaagaacttttctattaaggataaaatatgaagcaaattcctatgacagtgcgtggtgcagagcaattacgtgaagaattagattttttaaagaatgttcgccgtccagaaataattagtgcgattactgaggctagggaacatggagatttgaaagaaaatgctgagtatcatgctgcgagagagcagcaaggattctgcgaagggcgaattaaagaaattgaaagcaaattgggaaatgctcagattattgatgtaaagaatatgattaatactggtaaggttatttttggctctacagtgactttactcaatgtaaatacagatgaatgtgtgacttatcgtattgttggtgatgatgaagcaaatattaaggatggcttaatttccgtcaactctcctatagcaagaggattagttgggaaagaaattgacgacaatgtacatatacaaacacctggcggaaatgttgaatttgatattattaaggtagaatatatttaagttaggaaagtggcagttatataaaagtagatgtaaatatagtttttcatgtttcattgtaagagctcaattatcgtactagtggggctatatttacataacttgacgcaaactattgacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaattgtgggagaggctctcacaaatcgacggcagtaattattttttcatctacttcagaccattttttctttaacgacttcccattccatttcattgaaattcaaaaagtatcgccatcaattctagtctgaatttctgttagataaagtgtatttgtgagaggtatagcttgtttaagtagcttgcctcccccaatagtcatgatttcattgctactataaaagcctattcccattgttgccgtgcaagcgaacatcagaaagcccattatttggcaacgctgttcatcactagacttggactataaagagaaaataacagcgcatataatgtatttccttcataataaaaagaaatgcgcctactaacgactacttaaacagtcatagatagacgcataattaaactataataacgacggcgctgcatctaatagaattttggtgtactcttcttttggtgtgtcgaatacatcggcggcattaccttgctcaacaattaatccaccattcattaccacaattctatctgaaacttggcggacggtttgtaaatcgtgagagataaacaccatcgcaagatttaactcttttttcagatcggctaacaggtttagtacctgcgcacgaacggatacgtcaagtgctgaggttggttcgtctgcaacaatcagttttggatttaacgctaacgcacgagcaatcgctacacgttgtttttgtccaccagataaacgagttggctcaacaagtgcggcggaacgtggtaaaccaacacgagaaagtaagtcgtaaacacgtttttcacgttcgtgcggttgcagtacgttgtgaatatccatcgggtctttcaaaatatccaatactcgcatacgagggtttaacgctgttgccgggtcttggaagatcaccgatacttgacggccaaactgtttacgggcttctgcactgccgtatttcatttgtaagccgttgaatttggctgtgcctgatgtcggtttttgtaagccgataatcacgtttgctagggtagattttccgcaaccagattgtcctactaaaccgaccgtttcacctgcattgacttctaagctcacaccgcctacggctgtgaattttttcgggttaaacagcgtgccatcacgagatgggaaccgtacaacaatgttctctaattcaatgataggctgttcttttaatggtttcatactcattgtttatccctccaaatgtgaagcccaaaggtgtttcggattgtcgcttgctggtacaagtttcaagcgttgatttggacttgcatctggacgtaatgaacggcttgcaaagcggtcgcctttcgcaaaatcaaacggtgatggaacactgcccgggatttgatataaacgctctgcacgacattctgttgagagtacagaaccgagcaagcctcgtgtatattcgtgtgttgggttagacaataacgctgaagtcggtgccatttccactacttgtcctgcgtacattacgatgatgtggtgtgccatttgtgcgactaatgcaaggtcgtggctcacgaacaccattgcaaagccaagtttttcacgcaattcgttgagtaatttaattacttcggcttgaacggttacgtcaagggctgtggttggttcatcagcgataagtaattttggttcacgtgctaatgccattgcgatcaatacacgctgacgctgaccacccgataattcgtgtgggtagcggtttaaggttttctctggatcgagttttacccattttaatagggtttcagcagattgtttaccaccacggctgataagctgtgccatttggtctttaatacgcattgatggatttaatgcacttaaggcatcttggtagatcatagagatctcgtgtccacgtaattcgttgagcttatcggtttttaagagatcgtgttggttgcctgcacggtcggtaaagagaatttccccagtgattttggctgtcggtggtaataagcccataattgagaaggcagagatagatttaccacagccagactcgcccactaatcccattgtttcgccttcattaacggtaaagctgatattatcgacaagcggaatatcgccataacgatttgggaaacggattgagaggtttttcacctgtaaaatcggttttgcatttgggtttaattgcatacggtctgtgcgagttgcttctttctcgtgcaatttgagtaagtagcgttttaatgcaagactttctgccattgcttcttgtacatctgttgaaagcggttttgatacgtcttcttttgatgtggttgggctacgtttcaattttggattgactaacgcgtcagttaaaccttctgagagaatgttgagcgagagtactgttaggagaatagccaaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaaaggttgttgcccaccagaaaccacttaatacgatgttacgtccttctgacaggatatttccccaagatggttgtggaagttgtacacctgcacctaagaaagagagagaagcctcaagtacaatcgcatcagctaccattacggttgcaaagactaatacaggtgcggctgagttgcgaacaacgtgtttgactaagatgtgggtacggctaccaccgataacacgttctgcacgaacataatcttcttcccattgagaaaccacgttagcacgcaccacacgagcaagttgtggggtgtaaacaatcgcaatggctaagatgataatcggcactgcgttacctaaggttgcaagcaatactgcggcaagtgcaatacctgggaatgccattaagatgtccataaaacgcataatgacttcgttaccaagtttgtctgcggtagcggctgttgcccctaagatacttcctagaacaatggcaagtcctactgcaccaagtccgataaagagtgatgtttgagcaccgtaaattaagcgagataaaatatcacgtccaagacggtctgtcccaaaccagtaatctgcatttggtgcttgaaccgggcgaagggtttgcaatgggtcgtatggtgatacccacggtgctaaaatagccagtaatgctacaagcacaataaatcctaatgcgagtttagaggcggttgataatgctttaaatcttgccccgcctgaagcaagtctatcagctaatccttggcgaaacattataaactccgaatttttggattaatcagtaagtaaagaatatctacaatgatattcaccaagacgaaagtaaaggcgatggtcaatacgaccccttgtacgaggtgtaagtcgtggtttacgataccgttaaaaatcaatttacccattcccggtaagtcgaagatttgttcgataaccactgcaccacccagtagatagccgacacgcaagcctaaaacagtaacaggggtaattaaggcattacgcaatacgttatgacgaataaccgttgcataaggtacgccattaccaattgctgtacgcacataatctttgtccatttcttctaccattgtggtacgcaccacacgaattaatgacgcacatacagggattgccaatgctaatgctggtaatgccattgaacggaaatattctgttggatcttcactaaatgacacaaacccacctgatggaagccagtctaattcaagagagaagtattgaattaataagatacctaaccagaatgatggggttgccactgccgctactgagagtaggcggataacttggtctgcccaacggtcacggtagagtgccgcaataatccctaaagagaatgatacgattgctgctaaaaagaccccaatgaaagtaagttgtaatgtaagtgggaaggcttttgcaatcaatgaggtgattggctgttccggcggtgtggttagaccgaagtcaagtaccaaaacgttaccaatgaaacgaaagtattggacgataacaggatcgttcaatccgtgttgttcacgatacaattctttcgcagcatcacttgcactttcacccaatgcaacagaagctggatctccaggtgtgaactgtagaatgataaaaactaatgcacttacgccaagcatcatcagtggtaatgccattaatcggcgtagtaacagacgaagtacgatttctattttttttctccgactacaagaaaggttagtgggataggtttatataatttttataagaaaagcggtgagattaccgaaaaggtttacaacttttacaacaatcttatcgcttgaaagaaaccttaagtaagacgctactttaaacgccttcacccgaaggtgaaggcactatgattatttacggcttacaccaatgaatgacatacctgtggttgataatggtttaaagccatctaatgctttgttactccaagctgttggaagtttacggtgaataattggataaagtgctgcttcttcagcaatgatgttaatcgctttaccccaaatttcacgtgcttctgccggagttttcgcagccaccgcagcgtcaagaagtttttgaacttccgcatattcaggtgtatttgaccagcggaaacgttttttcggccatacatcaccacggtaccaccagcttaataataagtctaagtcgttaccgaatactgatgggtcacctggtgcgattaatacttcaaagttacctgcatcaacaccgtcattgtatggtgattgtgaagcgatgtttgtcacttttacaccagggatcttgttccagtcttcaaggatcatttgaacagagtccactacccatttatgtgcggttgaacgtgttgtaaactcaagtttatctacacccgcttctttcaacaatgcagccgcttttttcggatcgaaatcatagactgttgaggctttcacatagtctgggtgagagtcttgaacataagatgttgcaggttttgcgttgcctaagaacaccacatcaactaatttttgtgtatcaattgcatattgtaatgcttgacgtactttcttgttgttaaacggtgctttttcacagttaaacattaagaaaattaagccgaatgattgcactgattctacagctgctttacgttttaagcgatccgcatctaagtaaggtacgttttcaatcgcttgtacacgacctgactcttgtgctgcaacacgtgctgcgtcatcagagagtaagaaccatgtcattttttcaacagttgcaggatatggacctgtgtaagcagggtttgcttcaaatacgatacggtcatctttgactgctgaaacaaatttatatggaccggtaccaacagggtttgcatcaaagactgattgaccttgagcttcaattaatgcttttggtacgattttgataatggttaaacgttctttgaataatgcaaatggatatttcaatttaaattcaactgttttttgatccactgcagtgactgatttaatgaatgggatgaattgtgcaaagagtgattttgtatttggatctaatacacgctcaaatgaaaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacatcagcactggttactgctgaaccgttatggaataccgcaccgtcacgtaaagtgatgcgataagttacatcgtcaactttttctggttctttcgctgcaagtgctagatatggctggcgagttgctgggtgtaaatcaactaaaccttcaaaaatgtggatattagccgccattgaagatgcaccagttgaactcattgggtcaaaacccgttgaaatcggataagcaatacctgcttcgatagttgaaccttttgccggagctgcataagcctgagaagcaaaagtaccgattgaacctgagaatgctaaaccagcaccaacacctgcaactaatttcataaagccacggcgagattcattgtgttcaaaatgtttagtcacattagactccttgatagtatcgtttttgtaaaatggttatgtgcagtacaacacacattaaacaaccaaaaagtttcgtatttacttctcattttcaagtgaattaatcaaaatgaaaggtaaaaatgaattgaaaacattataacactaatcaaggcgatgtcaatatattgtcaagacgagtatttacatttgtgatctacttcacgaaatcagaaaataatctagctttagctaggcggataaccgacatcttctaaagtaggattatttgcaccttcttttgctaattgatcacaaatttcattttctgtatgtccagaatgacctttaacccattgccattcaacctgatggcgtgttatggctttatccagagctatccacaaatcctgatttttaactggcgtattattactggttttccagttatttttcttccaattaaaaatccatttttgaataccattttgcatatattggctatcgctatgcaaatgtacattacaaggctccttcaaggcatttagagcggtgatcacggcaagaagttccatacgattatttgtcgtcaagtagtaaccctgacttatccgtttttctttgccttgataacgcaataaaatacctatgccacccttacccggatttcccaagcaagaaccgtcagtgaaaatatcgacaagtttcattggggttatagtacgatagttttattttgataaacaaaaacacgatcagcaagcaccaattctaatgctctgctcaataccgttttttctacatctcgtcctgctcgcatcatcgcatctgccgtataagtatgatccacattaatcacattttgcataataatcgggccttcatctaactcattattgataaagtgtgcggttgctccaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattttaacaccacgctgataggcttgttgataaggcttcgcaccgataaaggcaggtaaaaatgaatggtgaatgttaatcacacgatttgggtatttcgccacaaactcaggatttaatacgcgcatatattttgctaacacaatataatctggggcatactcatcaattttatccgctagtagtttatcgtgttctacacgagttaaaccctcgtggcttactaaatggaacggcacatcaaaacgttctgctaaacttcttaatgtatcgtgattaccaatcacagccgcaatttcaacattcaaaccaccataataggtcttcattaaaatatcgcctaaacagtgtgcttctttagtgactaaaattacaatacgtttacgttgttgcggaacaagtttataaatagatccttttggcaaggtaaattctaaatcggctaatagggtctgatcgttgaaaataccttgtaattcagtacgcataaaaaagtggcgagtatcactttcaacaaactcactatttttaataatgtttaattgatgtttataacaaatattcgtgattttagcgacaagccccgtatcatcaggacattccgttaataaaattttattttcaatcattttgttttctctatttattagaaaaatagctaattcatatcaatcataaaaaaagaaaacccacatcttgtgggcttctctgtattcatatcaaattagattgcaaaatctgctaatgatttacccgcttctaatgcttgttgaatttcacgaggcgttctgccttgacctgtccaagttttttcattaccgtttgcatcaatgaatttatattttgctggacgaggatcacgttttttacgttctactttggttgtacctgctaataataacgcaagttcttctgctgaaataccatcttgagcaagtaactctttgtatttatttaggctttctaaacgttttgctttttcttcttgttgaactttaatttcttcacgtttttcttcaataacaagtgcaattttctctgcgataagttccaattgttcaattgaagcttcacgagcaattacacgcaagctacgaatatttgaaagcgtttttaataaatcagtcattgttttctcctaaatgtaactagttcatatcaatttagacttttttttatattatcgtaataattatttcaggtaaatacacaaaataaaattcttattatattttgataataacttaaagcaaactagaataaatctgacatattaatttatcaaaatccatctttcccctattggcaaccgccgtttcttcaggtaagctattagtgtcctacaaattgtagaggtgcgaatgcgataagtattctttcagagtggaaaacgatgaagaaagaggaaaggcgtattcgccgaaatcaattaagcgtcatcttaattggttggtatcgttatcgaaaggaacgatactgtcatagcggaggctatggagtgctactgttaggctgggtttattctgtttttcttttgttcccttccctaaacaccttgcttcatcaaaagtaagtttattccagtagatctctttctttgtttgacgtgttattttattaaaaacaatcttagaggttttatgaatctagttgattattcaagttcattgtggtctgtagtgcctgcattattagcattggtacttgccattattactcgtcgagtattactctcattaagtatcgggattattgtcggtgcgttaatgcttaccagtggcaacccgattgatacctttttacatttgaagaaaaatatcacttcgttaatttatggcgaagaaggattaaattcaaataacgtacacatcattcttttcttacttttattaggggtactcaccgccttattaagcatttcaggcagtaaccaaacctttgtaaattgggcccaaaaacgtattcaaggaaaacgtggtgcaaaattaatggcggcggcgttagtgttcgttacctttatcgacgattatttccacagccttactgtaggtgcaattgcacgtccagtaacagacaaattcaaagtttctcgtgccaaattagcttatattcttgactcaacagcagcgccaatgtgtgtgttaatgccaatttcaagctggggtgcttacatcatcactttaattgcaggtctattaaccacttacggcattacaaactacactccattgggggcatttatggcaatgagtgcgatgaacttctacgctattttctcaatgattttagtctttgtagctgcttatttctcaatcaacttaggctcaatggctcgttttgaacaacaagctgagcaagctgcagatgttgaagagcaacaaattgtcgaagcaagtggtagcgtgatgaacttaattttaccaatcatcaccttaattttggcaacccttgcaatgatgatgtacacgggtgaccaagctctagcagaaagtggcaaaccatttgatgtattaggcgcatttgaaaatactactgtaggtatttcattggttgtaggaagtttgagtgcattagctgtagcgactttaatgattgcaataggacgtaaagtaacaatgagtgattactggaagtcgtacggtatcggtgcaaaatctatgatgggtgcaatcaccattttattctttgcatggacaattaacggcatcgtaagcgacatgcaaacaggtaagtatttatcgacccttgttgctggcaacattaaccctgcatttttacctgcaatcctctttacattaggggcagcaatggcattctcaacaggtacaagttggggaacattcggtattatgttaccaattgctgcagctatggctgccaacgcagaacccgcattattattaccttgcttatctgcggtaatggcaggtgcagtatgtggtgaccactgttcaccgatttcggacaccaccattttgtcttcaacaggtgcacagtgtaaccatatggatcacgttacttcgcagttaccttatacgcttgtcgttgcggtggcttcagcagtgggttatttagtgattggttttactacctctgcattcctcagctttgcagtaacagcagcggtattagttactcttgttatcctattcaagcgtaaaaaatagtgatatcagctcttatagtaagatatgagtaaaacaaagcgaatcctcgtaattcgctttgtttatttatagcaaccggttaaaatagctcgattttttacattttatggatagattatgcttcccgaactgggttatttctgtttagtcttattagctggtatttcagggttacaggttttatgttccttatggggagaaattcgccatcaacccttttggttgagtggaaatcgcctatttagtttaattcaagccttattagccttagcatgttttggctgtttagcctacgcttttatctatgatgatttcagcgttgcctatgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgctcattctaatagtcaattacccacattcttcaaatttgcagccacttggggaggacacgaagggtcaatgctgttttggctaacggcattggcattatggacaggcatattttgcattttttcaggcaaaatcgaccgcttgtttacttaccgcaccctcgcctctctcgccttaattattttaggctttgctttgtttattctcttggtctctaacccatttgagcgtagttttcccccttccccagaggggcgagatcttaatcctatgttgcaagatgtcggattaatttttcacccaccactgctttatttaggctatgtaggctttgctgtcacatttgcaatgacaatggcaatgttgcttggtggcgtgtttgattatgctattgctcgttggatccgcccttggacaatggtagcttggggatttctaaccgcaggcataatattaggtgcttggtgggcttattatgaacttggctgggggggctggtggttttgggaccctgttgaaaatgcctctttaatgccgtggttacttggtactgctctgttacatagtttagtcgttagcgaacagcgaggcatttttagttattggacgattttattagccatctttgcctttgcattaagtctgttaggcacatttattgttcgttctggggttcttacttctgttcacgcatttgcagtggacgcagagcgaggaatggctctgcttattttgttctttagcttgagctttgttgcattggctctattcgctttacgagtgaatttatggcaaggcaatgttcgttttcatctgttttcaaaagaaacggcattattattggttaacggcttatttgcattagccacgctggtggttattcttggtacattttatccgatgatcttcagtgcaatgggctggggctcgatttcggtcggcgcgccctatttcaatacgattttcacccccttagcattgattttgttatgcctaatgggatttgcaatagtgctacgttggaagcatattccacaacgtcaaatcttgtggcaactggcgttactgcccgttgcggtgttgctcagtttgggcttcagttatcaagttttgcaacaggtctatgtacatcaattacagtggcaacccactctttttatctcactggcaatttgggttgtactaactcatctaccttatcagcgatttatgtggcaaatccgaccgcttgcaatgcgactggctcatattggttttgcgataagtgtgattggggcaatgatgaatagctattatgctgatgaagttggggtgagattaaaaccaacgcaatctgctgaattagcggggttacgctttgaatatgtcaaacaccacaatgaaattggggcaaactacaccgctgaagtggcagagtttcacctttatgatcaacatcatcaaaaattggcaaccttattgcctgaacgccgttactatgatgtccgcacaatgacaatggcagaagtggggctagcccattatggtttagatgatatttatattgtgatgggcgataagtttggtaataaagagtacgcatttcgtctgcactacaaaccttatgttcgtattttgtggctaggcggtgcaataatggtcttggcgagcctattggcattggttggttatcggagaaaaaaatgaaaaaaggattgctgtttttaccgcttgttatcttatttgcggttgtactttttttagtaatgcaattaaaagaaaaagacaatgtgccgttaagcgaagattggcaaggtaagccgttacctgaatttagcttaaaacatttactggataatcaagcggctatcagtaaagcaagtttactaaatgagccttttattttaaacgtttgggcgagttggtgtacttggtgtattaaagagtttccgattttacttgagatgaaacaacaaggggtaaaaattgttgggctgacctacgcagatcgccccgaaaatgcacggcaagcccttgctcagtggggaaatccatttgagcttgtgattgatgattgggataaaggttttttaacggaaaccctcagaatttcttctgccccctcaagttatctcattgataaaaatggtattgttcgttaccaacaaaaaggctacaaccctaattttgctcaagattttatgcctcgtttgcaagcattgaaggaacaggataaatgaaacggatcttatttttactgttcagttttatcgccctcgtagctcaggcagaaatggtggacacctttcagtttcattctgatagcgaacgtattcgtgcgattaacctagcgaaatcattgcgttgtttacagtgtcaaaaccaaaatctagtagagtccaacgcttctcaagcctacaaattacgtatagaagtctatgaaatggtcaatcaaggaaaaagcgaccaagaaatcattcaaataatgacagatcgcttcggggacttcgtccattatcagcccccctttaatcctcaaacgtgggtgttgtggggaatgcctgttggcttacttgttctactctttagcctgattttttggcgaacacggagaaagcaaaatgattaggaacgaacttaatcgggcttattatcaacaagcggaacgatttgccgatacttttgcagaaaaagagcgtaatgaatatttagccgaattggcaagccgtcaagcgtttgaacaacaaaatgatgtagtatcgcaatggcagaaaaatccacttaaacgcccgcttgtagtaaccgttttgttgattgcccttgtcgccagccttctctattattggcagacagggcgttatagccttgctattcaaggggagcaggcttttgctcaatttcaacaacagcgtgcggaagaaagtagtgaacagcgtaatgatcactatattaccaaccttcaacatcagcttcgccagaatgccaatgatggcaaactctggtttgagctagggcaggcttactcactcaataacgatttcgaggcagctttaacttgttttcgtaatgctcagactgtactgggcgaaaaggcgagtattttaggtgcaatggcaacagccgattactatttgaataaacagcgactttccccgcaagcaaaggcttggcttgagcgagcgttacgaattgatgataaagagagtgccagcttgcttttgcttgcctccgatgcttttttacataacgatttcaaacaggcaattcattactgggaaaaagtattagacaaccagaacgaagccttagatcgtaaagagatcattcaaagtataaaaatggcggagcagatgttacgtgagaaatagtgccatttatggttgtttgatattgatcatcacaataatattttaaaagattctaaatttttaatcttagtttttctttatagcaaacaacaccaactctctcatctggaaacttaccgatacttttgcttccagtggcaaatctgccgtttggtaagcggtaacatttgtgccgtttattgcgatttgataacggtagaattgccctaataacagtttttcaatcactacaccttgcccgttatcatcggcttttagggtaatctgctctgggcgaagcaaccaatgataatcgccaagcggatactcgatttcagggaattgataagtaccaatcgggctttcaaggaagtgattttctaacactttgcacggcaggtagtttgtgccacctaaaaagtcagcaacgaaagcgttcacaggggcgcggtagagttcggttggcgtaccgaattgtacgatcttaccctgatccatcaccgcaattttatctgcaaaggcaaaggcttcttctttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtgggtaacgaaaatcgcagggactttttggctttttaagatctgtttaatctcttggatcatcgcatagcgagtttggctgtcgatgttggaaaagggttcatcgagcagtaataattcaggttcacaagctaaagcacgggcaatggcgacacgctgttgttgtccgccagagagttcgtgtgggaagcgtccttcaaagccttgtagtttcaccacggataacatttgctgggtgcaacaatgttggtcggatttacacattttgcataagccgaattgaatattttgtgccaccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcaatcggttttttctgtaaatcttccccagcaagaaaaatgttgccttcgctaatcggaagcaaacctgcaatcgctttgagtagcgtcgttttgccacaaccgcttgctcccaatagacagacgatttcattttcgtccacggcaagatcgagggattttagtaccacattgtcgtcaaattgacagctcaaattttgaatatcaagtaatttcatattaacgttctttttgcgattgagagattaacgaacgggtcagccaaataacagggattaatccgactaacaccaacacaatggctggcaaggcggctcgctctaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgtccgaagtaaaggtgaaaacgtgggtcgctaaggtatcaaagttgaacggtcgcaataacagtgacgcatttaactctttcatactttcaataaagaccattaagcctgcggtaataattcctttggtaatcaaggggatatgcacacttctaaacatggataagcccgtttttcccattgtctggcttgccatatccaacgacggtgaaattttgccgagtgaggtttcaaggctaccgattaccattgcagagaagcggatcacataggcaaggactaaggcaaacagtgagccagaaaaaatcaagccaacaggggaaagctctaaagatttcagtagcgcgtgtagttggtgatcggcaaaggttaatggcgacaacaagccgattgccagtacagtccctggaatggcatagcccaatgaggaaaattgtaacgacaagcgggtcgatttcgtccaaaatctgcgattgaccgacagacgatgagcaaaatgcagtaacagagcaagggcaacggtaatgatcgaggcaataatggatacttttaagctatttgaggcaaattgcacaaaatctaaattccacgactgttcaaaatagtggaaagaccaatagattaatcgaccaaatggaataaagaacgccaatgccaacaacccccagcaccagccttgtgcaagccacagtttccagcctgtgagctgtttgaacgaggttttcttttcatagccacgctgatagcttttttgtttgcgacggctgtattgctcaaggctgataaacagaaaaatcatcagcaacataaaaatggaaatacggcttgccgtgccgagatcttgaaagccgagccacgagtcgtagatggcagtcgtcaaagttggcactgcaaaataggacaccgtgccgaaatcgcctaaggtttccattgcgactaacgccataccgacagcaattgcagggcgaattaaagggaaagtaattttacggaaaatatccgctggcgatgaacctaacattctggcactgtgagtgaggttttccgattgttctaataatgccactcgagccagtaagaaaatataagggtagagtacaagggctagcacaaagcaagcaccgtaaagggtgcggattttcgggaaccaataatcgtgcggtgtttgccaaccgaaaataccacgcaacatttcctgaaatgccccagaatagtcgagtaaatcggtataaagataagcgattaaataagcaggcattgctaacggcaagcaaagcaaccattgaagcgttttttgcccacagaattgataattagcgacgatccaagcggacggtaatgcaaaaaaaagtgcaaggacgacagtgcctaagactaacaggcttgagttaagcagataagtgcctagcattgtatcccagagatgaacgagattttccatttcaccttcaaaagcgtgatagccaatggcaagcaacggaagaaggattaacagcgtagttgcaagggcggaaagttgccaagtcaggtatcggtttatcataaatcgatcaaaatctcattccattaaaaaacaaaattccccctttgcgaagaagggggtagaaattaaattcgacgtatttgtagggacacgacgcttcgtgtcccaatatccacattggttgtgtattagcattggacgccaagcgtggcgtccctacaaacgttacaatattaattatttcgcaccgaaatcatcaaatttaacttcatcaactaatttcaatgctttttcatagtttttcgcaatgtcttctaattttaatgcatcggttgagtaagttccccagccttttacaagatcagaaggtgcaacgtcagcttttactgggtactcgtggttaagtttagcatataaagcttgagcttggttgccactgagatactcaattaatttaattgcatttgctttgttcggtgaatgtttcgctaatgctacaccactgatattaacgtgtgtaccgtattgaccgttagggaagttaatgttcgcagactcagcccaagatctttgtttttcatcatctaacattttaccgtagtagtagctgttacctaacgcataatcacaaatgccttctttgattgctttaacttggtcacggtcgccaccttgtggtttttgtgcaagatttgcttttaagccttctaagaatgctttggttttttcttcaccgtagtgttcgatcattgcagcaaagagagaaacgttgtaagcatttttgccagaacgaacgcacactttgcctttatattcaggcttagctaaatctaaatagtcaaacccagcaggtaatgcacctacacgatcttttgatgtataaataacacgagcacgtttggttaaaccgaaccattcgccatttgaatcacggaactgcgcaggaatatttttctctaaagtttttgagtctactttttgagccaagccagctttcacaatttgcattacacggctaatatctaccgttaaaagcacgtccgcagggcttaattcgccttctttttgtacacgttcaactaaacctttgtctgcaaagatcacgtttactttgatacctgtttgtttttcaaagtcttttaacatcggctcaattaagtacggctgacggtaagagtaaacattgacttcgtttgcagctaacgcagaagttgaaataacagaagataatgcaagtgcaagcacagaaagagattttttcataaaaatgtcctcattaggaaagggataaactcactataaatagcgagcgtttacaaaacagtgtgagtttaaaatatttacatttttatgtcaagtaagaactatttttatttactaatgggtagttaatctcattcttaataagatgaaaagtgaaacctttttggggcatcctatagtcgcagcatattatccggtattatgaatcaagtgcacaaatacctcatttcaataaaatctgtgtataatacctgctgttttgttagcaataattttgctttcaatgaagttaatgtttgctcgtataattttgtactgccttcgtgattaatagagcaacagactgtaaagcctatgttaagcagagtattgtctttttcatttaaattattccgtaaattaagataggttaaaaactaacttaattgtgcaaaaagaaacaaaatgcaatcaagatttaattgataaacattaaatttagcgtctaaaaaatatttagagatgaaagaaaggttttaacgattattcaaatagcatttataaattaaatctattgaattagatcaaaataaccgtagttttttatagggataatatattcgctttttactttatggagtgttaccaatgaaaaaactactgttatcagcgattgccttaggcgttgctggatttttagggatggttgggtatttgcatacctttgaccaagaccaagcagcaaaactacttgcacaaactaattttagtggtaaacagcaagaagtggcgaaagtcttttttgaaaatggctgtcagtattgccacagtcctaatgcagaaatgcctttctatgccaaaattcctggtgtaagttcaatgatggaaaatgatgttgcaacaggcaaccgctttttccgtttggataaaatgttagaaggaatgaaagatcctgctaaattatctgaagcggatctggctaaattagaaacggtgttacgcaacgatacaatgccaattgcgagctttattcatattcactggggttctcgccctgatgagcaagaaaagaaaacggtgcttgactggatccatcaacagcgtgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatccatcaacagcgtgcggagcattttgttccaaaaaatacggctggagttgatccaactcgcttagttcaacctattcctgatgcattaactacagatccacgcaaagttgccttaggggatcaaatctatcatgacgggcgtttatcaggcgatggcactgtggcttgtagcaactgccaccaattagataaaggcggtgtggacggcttgactacatcaacaggtattcgtgggcaaaaaggcggtatcaatgccccaacggtatataacgcagtctttaaccacttgcaattctgggacggtcgtgcgaaagatttagcggatcaagcaaaaggcccaccgcttaaccctgtcgaaatgggttcacatagttttgatgaaattttagcgaaattcaaacaagatcacgcttttatgcaagagttcttagcggcttatcctgaattaaccgcagacactttaacagatgccattgcagaatttgagaaaacgttgatcacgccaaacagtgctttcgacaaattcttaaaaggtgatcaaaatgccctgaatgacgcacaaaaacgtggttacgaagcatttaaagcggcgaaatgtgacacttgccatacaggtaccgcaatgggtggacaatcctttgaatatatgggcttatatgatgattatttcaaaacgcgtggcacaccaattaccgcagacgatcacggtcgtttctcacaaaccaaagatcctgctgatatgcatcgcttcaaagtaccaaccttgcgtaatgtggctttaaccgccccttatatgcacgacggtagcgttaaggacttaaaagaggctgttcgagtaatggctcactatcaaagtggtaaaaccttaaccgatcaagagttgaacgatattacttcattcctagaagccttaaccggtgaatatcaaggtaaagtattaactcgtcaggattagcataaattgctaagtcgtcacaaaaacgatataggagaaattaatctctgacatatcgtaagaacaagaaactaaaagggctgaaatcaatataatattgttttcagcccttgattaataatttagatttatacaaaccttccttgcttaattttcatcaaacaagaatttttcaaaacattagcgacgtaaacctaaacgtgcgatagtttctgagtatttagcaagatcagtacgttttaagtagtctaataatttacgacgacgtgaaaccatacgtaataagccacgacgaccgtggtgatctttcttgtgctcagcaaagtgtgcttgtaagtggttaatttgtgctgttaaaagagcgatctgaacttctgaagaaccagtatcttttgcatcacgaccaaattcagcaacgatttttgcttttgcttctacgcttagagacattttttactcctaaaaagtagttaagtttatattcatcaatagccgatctctaattcagctacgacacgaagttgcgtattctaaagagaaaagctgtcaagagcaatgcttttctctcagaatagcttaaactaatgtttggtatccgattgactttgtggttgtagatattcttctcgattcggatcaacttgttttgatttacgaatcattggctcaatagttgtaccttgtaccaaaatagagaacatcacaacagaatatgtcatcaccagaattagatctttaacatcaataccattggcataagcagttttggctggaatagaaagtgccattgctaatgccaaacctccacgtaatccgccccagctcatgatttttaaggtatatggattgtaagtacggaactgttgtagcgccttatatggtaaccataagctgatatagcgagatgctagacaaatcggaattgtcagaatcatcatcacaataccgtagatattaaaatcgacgagtaagatcgcaaaaccgataaggaagaaaagcagagaatttaagaaatggtcaatcatttcccagaagtgatcaagataacgttggctctgttcagaaaagcctgaacgacgggtccagttaccaatcataatgcctgccacaatcattgccaacgcacctgaaacgtgcagaacattgtttgcaaacataaagcctgcggttggaatggtcaaagttaataaaatttctaagctaccatcatcggttgatgaaattaaaatatgagcaaggaagcctagcacaaatccaaacaggataccgccgatagcttcatgcaaaaagaggctcataattccactaaaactggcttcttgaccaccaaatgcaacagcaaacacagtgacgaagataactaaaccaacaccgtcattgaaaagcgactcaccttctacttgcatagataaacgcttcggtgctcgtaaatttttgatgatcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtacagcaattgggtcagttggagaaatcagagcaccaaaaacgatacagtaaatcaaatcaatttgtagcccaattaagttggctaccccatagacgaagaaaccaataatcaaagttgaagctaaggttgagaataacgcaaaaatggtaatttcccatttttgatctttaagaacagggagtttaattcctagtgaacctgcaaagagtaggaaccctaaaataccgttaagtaagaaactcttgaagtcgatctgttccatgacttctgttgcgacagcatcaaggttaaaccagccgaaagttccgagtaacagtagtaagagagaaccgatcattgctgcagctgtaatagcaatggtcgattggattttatcgctgattttatgagtaatgaaacctaataaaatagaaagtgctgataaaaaacagatataagtataaatacccatgatggtatccttatggagacaaaaaagaaagatccttgttataaatagtctgcaaattaaaccaaatttttaatctgattgcaaaaaaataaaagatattaagtgagctatttcacaagtaacaatttgagaattttccactttaacggtataattaagagtagttttttgtaattttagggatcataaagatgattgaaaaaatgcatgagaaatctggtgggtgggtatttaaaatcatttttgcattagtttctctttcgtttgtattaggcggtattggtggtgggttgatggctacagacaattccgttgccaaagtcaatggagaagaaatttctcaacaagtatttagccgagcaaaaaatcagcagcaaaatatcctaaatgctcaattaggtgagcgtttttgggatttaatggacaatcctatttatgtcaaacagttccacgagagtattttaaatggtttagttgatgacgagcttcttcgtcaatacgctaagagccttaaaattgacgttagtgccgatcaaattaaatcagaaattgtaaacagtcctgctttccaacaagatggtaaatttaataataatttatatcagcaagcattacgtaataatggtttaacggctgatggttatgctgcaattgtttatgaaggcatgctatttgcacaaattcaagaggctattgtaaatagtagttttaccgttcctgcacaacaagaactattagcgaaattattgttacaaaaacgtcaagtacgtctggcgacctattcaattgcaaaagaggtgaacaatcaaaccgcttctacagaagaaatgcaagcctattatgaggcaaataaagcgaattttgttaatccagaaaaattgaccgtagaatatatttctattgaaccaaaggatttggctaataaaattcaagttactaacgaacaaattgacacttattatcaaacaaacaaagctaaatatacgacaaaaggcgaagcgaaaatcgcacatattcaagtagccactgaagctgaagcaaatgaaatcgtacaagcactcgctaaaggtgaggattttgcacaattagcaaaagcaaaatcacaagataaattatctgctgctcaaggtggagatttaggttgggcgaaagcgggcgtcttcccgaaagcctttgaagatgcggctaatatgttagacgctggaaaaacaagccaaccaatcaaggtagataatgctttccatattataaaagtattagaacgtaatgtagaaactgttgtgccgttagagaaagtaaaagctcaaattacggatacaattcgtaacgagttacttttaacggagtattcaaacatcacccgtgaaatggcaaacgtagcatttgaaaatagtggctcacttgaagcggttgcaaaagtagcgaatgttctagttcataaaacagatgctttcacacgtgaaactgtacctgctgaacttgataacgagaaagtcctacgcgttttattcgacagtgaagtgcgccaaaatgggcaaaattcagaagctattgatttaagtgatgccacaaatactaaaacgatgtttgttcgtgtaagtcactatcaagctgaaaacgtacaaacttttgacgaagcaaaatcagcagttgaacaagcagtgaaacaacaaaaagcgctcaaagtcttagaagagaaagccactacacaagttgcagcattgaataaaggcgaaacagtagaagtcgcatttggtgcctctgaagaacttgtctttgcacaggcacaaatcactgaaccggctttagcacaagcggtcttttcaatggcaaaacctgcagaaaaaccgacatatcagaccgctcgtaatacgaatggtgacgtggttgttatcgctttagataaagtgagcgatggcacagctgacgagtttaaacctttacaagcacagtttaaccaagcagagcgagttgtgttacgtaatgatttacttaaagatttgcgtgaacgtgcaaaaatagaagtaaatcaagacttccttgatcaactcgaaagcagtaaataatatgaatgtgaatttggttaaaaatttgtaattgactttatctataaatttccgcaaaattcacgtaaattttttaatcttcagggcagggtgaaattcccgatcggcagtaaagtctgcgagcggcggcgaaagccaaagcaggaactggtgaaattccagtaccgacagtgatagtctggatggaagaagagctagaatgtctacactcgaacactgttcgagtgcttttcttatgcttttaacgccttgagatcgtgagatttcaaggcgtttgttttttcctctcccgtttacgggagagggaggagccaattcggtagaatttgcggagggagagggtttgcaataaacttccctctctctgcttttcgtaaagccgttactttgctcaaagctgtctctctcccgtgaacgggagagaattattcttcttccttgcccttcaatttatgatttaaaacccaaaatgacacactctatttttatggctcgtgccattgaactggctgaacttggtcgtggctggacaaatcctaatccgttggttggttgtgtgattgtcaaggacggcaacattgttgcggaaggctatcaccaacgctacggcgaatggcacgccgaacgtaaggcgattttacattgtcaggaagatttaagcggagcaacggcttacgttacccttgagccttgctgtcaccacggacggacaccgccctgttctgatttgttgattgaacgggggattaaaaccgtcgttatcggctcaagtgaccccaatcctctcgtggcaggcaaaggtgtggcacaacttcgccaagcggggattgaagtgattgaaaatgtgatgaaagccgaatgtgatgcgttaaatccaattttctttcactatattcaaaccaaacgcccttatgtgttgatgaaatatgcgatgaccgcagacggtaaaattgccaccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtaaaattgccaccgcaacaggcgaggccaaatggatcacaggggagcaagccagagccaatgtgcaatgcacccgacatcaatacagtgcgattatggttggagtagataccgtgttggcggataacccgatgctcaatagccgaatgccaaatgccaaacagccagtacggattgtgtgcgatagccggttacgtacgccattagagtgtcaattagtccaaactgccaaaacctatcgcacgataattgcgacagtttcagacgatttgcaaaaaatcgcccaattccaaccgcttggggtggaagtactggtctgtaaagcaaaagacaagcggatcgatttagccgatcttttgcaaaaactcggcgaccaaggcattgacagcttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttagaaggtggttcaagtttaaatttcagtgcgttaaacgctggcattgtaaaccgtgtgcattgttatatcgccccgaaattagtcggtggagttaccgccaaaacgcccatcggtggtgaagggatcggcgtgttggcaaatgcggtgcaattgaaaaatgcaaagatccgccaaatcggcgaagatcttctgattgattatgaagtaggaacacattgatatgttcacaggtattattgaagaagtcggcaaagtcgccaaaatccacaaacaaggggaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaatggcggcaaacggacgtttcggcggacatattgtgtcggggcatattgatggcacaggggaaattgtcagcattacccctgcgaataattcggtctggtatcagattaaaaccacggcaaagctgatgcgttacatcattgaaaaaggctcaattacgattgacggaataagcctgacggtggttgattgtgatgaaaacagcttccgcgcatcgattattccgcataccttaagtgaaacgaatttaggcacgaaaaaagtcggtagtattgtgaatttagagaacgatgtaatcggaaaatatgtggaaaaattgctgtcgccgaaacagagcgagccacagagcaatatcaccgaagagtttttaaagcgagtggggttttaaatcccccttagcccccctttttcaaaggggggaattatcaaaaaggaaagcaaaaaattccagaatttaaagtagggacgccacgcttggcgtctgtaacaagcggtcagatttaaagaaaaggaaagcaaatgtttcaattttcaagcgtagaacaagccttagacgcattacgtcaaggcaaaattattatcgtcagcgatgatgaagacagagaaaacgaaggggattttatctgtgcggcggaatttgccacccctgaaaatatcaactttatggtaacttatggtaaaggtttgatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaagctcgacctaccgcagatggtttcttacaacaccgataaccacgaaactgcctttaccgttgctatcgatcacattgatacaggcacgggcatttcggcttttgagcgttcgcttactgcactgaaagtggtggacgacaacgccaaaccaagtgattttcgccgtccagggcatatgttccccctgcttgcaaaagacggtggcgtgttggtgcgtaacggacacacagaagcaacggtggatctggctcgtttagcagggcttaaacaggcagggctgtgttgtgagattatggcggacgacggcacaatgatgaaaatgcctgaactacaagcctttgccacaaaacacaatatgccgtttatcacaatcgcccagcttcaagaataccgccgagcaaaagattgtttaattgagcagatttctgtggtcaaaatgcctaccaaatatggcgactttaccgcacatagttttatcgagaaaatcacaggcaaagaacacgttgccttagtgaaaggggatattggcaatggcgaagaggtgctgtgccgtattcactctgaatgtttaaccggcgatgcctttggttcacaacgttgcgactgcggtcagcaatttgccgctgcaatgagccaaattgagcaagagggtagaggcgtgttgctctatttacgtcaagaggggcgaggcattggcttaatcaataaactgcgtgcttatgagttgcaagataaaggaatggacaccgtcgaggcaaatttagctcttggcttcggtgaagatgaacgtgaataccatatcggtgcacagatgtttcgcagtttaggcgtaaaaacaatccgcttgctaaccaataacccagcgaaaatcgaggggttacagcaagttggcttaaatatcgtggcacgagagccgattatggttgaaccgaataaacacgatttggaataccttaaagttaaacaagttaaaatgagacatctgtttaatttctaaacttgttaaataacattcattttacggacacacgcagtgtgtccctacgacagttttatttttatatcaatttacattcaatataaggaaaagcaaaaatggcaattatcacaggtaatttagtggcaacagagttaaaattcggcattgtgtgtgcgagatttaacgattttatcaacgataaactgttaagcggtgcgattgacacactcgttcgtcacggtgcaagcgaaagcgatattgataccgcttgggtaccaggcgcatttgaaattccgttggtcgcgaaaaaaatggcggaaagcggtaagtatgatgcggtgatctgcttaggtacagtaatccgtggatcgactacgcattatgattatgtgtgtaacgaagcagcaaaaggcattggggcagtgagtttacaaacaggtgttccagtgatttttggtgtattaaccactgaaaatatcgaacaagctatcgaacgtgcaggcacaaaagcaggcaataaaggctctgaatgtgcgttaggtgcgattgagatggtgaatgtgttgaagggactttgatatttttattcactagagccttctccttttatggtcacattatggcgatcgnnnnggcgatcgtcaaataacacaataaactactttggataatacaatttaccttcgccatataaaaagagtttataacaacaacccatcatcactcaacttctcgtggcgactttgctcaaatagacgcaataaatctggtacatccatcttcttgcgggcatcgcccgccacatcaaaagccacctgaccttgatgcaacattacagttctatccccataatctagggcttgtcgcattgagtgcgtcaccattaacgtagtgagtttttgctctctaacaattttattcgttaattctaacacgaaagcggtcgttttcgggtcaagtgctgcagtatgttcatcaagcagtaaaatatttgaaggttgcaacgatgccattaataaactaaccgcttggcgttgcccccctgataatctgcccatttggtcagtcagacgattctccaagcctaatccaagtaaggataatttctctttgaacagctctctgacttggcggttcagtgcaaaatctaaccctcgtttttgacctcgttgataggctaaagccatattttcttcaatggttaaggcttcgcaagttcctgccattggatcttggaaaacacgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttactgccaattaccgatacaaattccccttcggcaacattcaggctcaatcctcgtagtacaggattttcaatcacagtgcctttattgaacgtaataaatagattattcaactcaatcattatcgacctctttttgcagtgaatttgtgcttgaatttaggtaacgtaagaaccgctacaactaataatgctgtgattaaattaagatcttgaggcccaaaaccgataccactcagcgtttcattatttaaggctaatgcaatgaaaaagcgataaagaatagagccaataattaccgcagcagttagacaaataatacgttttgcagagaaaatcgcttcaccgataatcactgcagccaatccgatcacgatagtaccgaccccaatcgaaatatcaaagccaccgttactctgtacataaagcgagcctgctaatgcgatcaatccattagagatagccataccaagcaaggtcatcttattaattgcaataccttgagcttttgccatacggggatttgtccctgtagcacgcacagctaaaccaatttgtgtcgcaaagaaaagatcgaaaatcaacttcgcaataatcaccacaaaaattgccattaacagtcgcaccattgctaattgaacatcatcttgagcagttatcgcatcataaatcgtcgcttcgcccagcaaagaaacattaggcgatcccataattcgtaaattgatcgaataaagtgcaatcatcatcaaaatgctggctaacaatttttcgattttaaaaccaatatgcagacttgctgtaatcatacctgcaacagcaccagccaacattccgcacaacgtggcgatccaaggatcgatatgatgcaaaatgcaaagcacacaaacaccgccacctaaaggaaaagagccatcagcggttaagtctgggaaatctagaattttgtacgaaatcagcacccctagagcaacgagggcataaatcaagcctaactctaaagctccgatccaagtgacattggtgaaataagtcgttaaaaattgaagtaaggtatccatctttaaatactactttactagtacaacaatgttttgcattgtacgctatttcagataaaaaaacagtaaaaaataggtttttgtaaatttttttcacgcaaacctttgcttttcaagggggtgccgacaagagaaaaaataagcggtaaaataagcaatagatttttcaaataatagaggatacaaatacaatgaacgcaattgaaattttgggctatgttgcaatgattttagtcgcaggttctttcttattaaaagacgtagtaaaacttcgtttagtgaatgcacttggtgctgtatgtttcgtgatttatggtattttgattaattcattccctgtaacaggattaaatatctttgtggtgtgtgtgaatgggtattatatttggaagagtcgctgttccaaataaagagttcatttagaattgctaaataataggcatttgatttcataagtaatcagatgcctatttatgtatagtaaagagtcattcatgtagagctcttctagagttctatattttcaatgttgctgacctaatatcacaaagccaatgcggcgccgttgtgcgatgcaagattttaaacgatgagcttgcaaaattcggcgatatttactgatggttaagcgtttaacacgctgtttcaatttacgttttatcataaatactccttatttactctatttttaattgatttttatgatttcctgtgtgttatttgagtttgatgtttcttgctctttcactctctgatgattgatcaagctattgtaataacgtcggatattttctacatattgaaaggcttcaaatccacgggcatatccgtattttagttgagtatagtaatgttttttagcaagtagaggcaaatttttctttacatcaagccaattatctggatttcctccaagttgtttagttaaacgccgcacatcaatcaaatgtcccattcccatattatatgccgccaagctaaaccaaatacgatcttccgatgcaatactttgaggtagctgattcattaataaatgtagatattctgagccagctttaatactttgttcaggattaatacgatctgtcacattcattctttctgcggtatctttagtgagcatcattatgcctctcacccctgttggtgatgttgccgtaggatcccaatgagactcttgataagcaatggccgcaagcatctgccattctaatattcctcggtatttttcaaataaatgtaaatatttaggcaaaacagtgtcgatagcttttaaatagctttggctatccacatagtcaaagcgatttaaataattgaaatatttttcctcaattcttgctattaagcctgtttcattcgcattatccataaaacttaatacggcagcttgcagttcactatacccgctattttgtaaataccatacaacaggctcctcatcggttaaatcaaatccaacggcaacatcaggtttaatatgttgtgcagctgagacatcaatagacacggctacagtataaggaattttgccatcggctacttgtattaataattcctcttgagtgaaattgtctgttactttccatttcaatgaggggtactgttcttgcaatgttgttaaaattggaataacagctgaacctgcagggattagtaattcatcttttaaatcaccaatgctgtaagggcgctgacttccttttttatacacaatctgccatgaggcagaataataacttggaccaatttggaatttatctgcattttctaattgatatagcaatcctgcagcggcaatatcaatttcattgagtttcaaaccattaaataattgttcgctattattgtagtttttaacttctaacccgacacctaaatattcagaaaacgctttagcaagctcatattctatccctgcggttccttctgctccctcaaaataagagatggggtgattaatcattcccaccttcagtattttacgttgttggatctgcgtataacgattttcttctgcctgcattgcttgttgccaaggaaataccatatcccatgcccacagcaataatgcaatcccacatgcaattctgatagctaagcctttcaatttctcctctctaaccttcactctcaacagagtgctgtagtttagcaaatctattatgagttcaatatgaatatattcttaataaatcaatttagtttaaccagtattcccagtttgaaaagaggaattaggggttgatatgtcgttgataagctagaagcgtattttgcattaacatagcaacggtcattggtccaacaccacctggtactggagtaatgaattttgccttttgggaagccacttcatattcaacatctcctaccaattttccctcaatacgattaatgcccacatcaatcactatggcattttctttaatccattccccaggaattaaattaggctttccaactgcgactactaataaatcggcttggcgtacatgattttctagattctttgtaaaacgatgagtgacagtgacagtacagcctcctagtaatagttccaatgccattggacgcccaacaatattggatgctccaacgataacggcatgttttccataaagattctcccctgttgtttctaagagcttcattacaccataaggggtacaagctcttaatgttggaatacgttggcataaacgcccaacattatagggatgaaaaccatcgacatctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctggagagatggcttcaatgatttttgttgtatcaacatgctcgggaagagggagctgaactaaaataccatcaattttttcatcattgtttaatttgttgattaaagagagcagttgtgtttccgttgtgtctgcaggtaaatcataagattcagaataaattcctaattccgcacacgttttacgtttactcccaacatatacctgtgaagcgggatctgagccaacgagaatgacggctaaaccaggagcacggtatccttgttgcacgtaagacgcaatgtgttcaaaaatttgagttttaatttgttgtgcaagtttattacccgaaataatttgtgcggacatgactaattttccctatgtaattgacaatatacattcggtattctctcaaaaaaattgctttttagtaagcattaatcttgaagatgtttaaagaacgaacatttaattgcaattacttaaaaacttattgaccttaataataaaatttttataatagcacgcaccttttttcaagacaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctatcgttttcaaactactatcttatcatagtgcaatgcgcccttagctcagctggatagagcaacgcccttctaaggcgtgggtcaaaggttcgaatcctttagggcgtgccattaaattattttaaaatcaatcacttacaaactatgcaactaatcttaatcgtggttcattttgcgaatgttccgtaaatgtaccgtaaatttcgaccttgtttgcgtgttccagtaaatgatctgcatttaaatgagcatactttttaaccatttctaaggtttcccaaccgcctaattcttttaatgtgaaaagtggtgttcctgcttgaacgtgccaactcgcccaagtgtgccttaaatcgtgaaagtggaaatcagttaataagcatttttttgtagccaaattaaatgcttttcggttaatatcctgtaaaggattgccgtttctgcccacaaatacatatttagaatggcggttgcggatagactcaagaagttttatggcttcttggttcaataatagcgatcgtgccttacctgactttgcaacatcattagtcacgattgctactttcctttcaaaatctatcttatcccaagttattgttaaaatctctgtgcgtcttgctcctgtcatcaaggcaaatttgcagatagatttcatccagtctgaacttaatttatctatgagctgttttgcttgttgtttcgtgatccaacgcactcgaattggcggttcttcctttttctgtacatatggcacagaatccagcataccgagcttatgagcgatatttaatactctcaataaagattttacatacttgttttgcgtactatgagataatgggtccttagtattcgcattcttttttgggatatttaagataatttcttgtgctgttaaagagctgagttctcgccctgcgaatttagagagccagtattctgcgtgtcgctttttcgtggctttatcctttaattcttcagcggaacggacataatgtaataaagcatcttcgaagatgtattttctctttgtttcgagcttatcttctgcccacatttcttgcttgagtttgtcgtgatactgctgtgcttcacgttttacaagcgtgcgagtgcttctcttaattctcttgccgtttggggttgtgatatcaacccaccacggaccgtttgcttttcgtctgtagatcgacattttcttttctcctcgaccaacagagataccccacggtcattattcgcttgttttttttactcggtcaagatctgatcgtttaacccgccaaactttagatcctgccattttaaaaaatccccaatctgctaggtgctggcggacggtatttgggtggcaatttaactctttggcgacttggttaattgttaaatgttctatgtgtgtcattctttttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctttccctgcgatgtcatttctaacataacgtggaatacctaaatcttcgtatagtttacggtggaatacttctacttcttttgcaaaggctcttgctcttgctaggtatttggcaatttgttctgcatctaaacctgtaatggtgatgtcttttttactgcggtcaatcggacgatattgattgccgagtgtgtttaagaagttgataacgtgttcaaacattgtttgcggtagttggtcatacttcgctacgttaaaagtgcttttgagccgagagtagatttcttgccagtgtaatcctgttcgatagtgagcctgttgtaccgcttcctgtatagctcgttgttgctcaggggtgattgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtaaattcgtctgcgttgcggtcgtagatttttacgattgcttttgtaggatcagcgtattctaatgctgtacctaaatcgtttgctgttaagaatgtgtggttgtttttattgataaccgaaagagtagtgttttgaaatgttaatgtagtcattttattgttccttgtgtttgttttaaaactcatcacaagctactgcaataactggtgatgaactggctaaggtttgcagtaaccgttacacaaggaagacggcagatctttcgatctccttaaccagcccatcattgactactttaaaagggttccccaatttggggctacctttgaaaagtttgatttgactagatttcggctataaaaaaatcgccattaggcgactatcattattaccgccacttattctttcaggactgcgattccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcagttggctattttattaaaataaaagcctccacaatggaggcttgtttccagacttgcgagttagatcgcaaaataatttcttagattaattttttggtattatgattgatattacttcataatcaaccatttaacaaatggtattaaaatcaacatgttactcttttaaatctattccagctagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactagataaaacaaaggggagccttttagctccccacttcacgattaagttagcttgttatcgctttgcttaatcgaccaaacatttttcagcttggttttacaagcccctttcgggttcactgttaatttaacttaactttaaggctttagcaactgcttttttgatatttgcaaaatcttcatcatcgatcacaggtacgacatattcacgtttttttagcttataacgatctaatcttgataatgatactgtataaaccatatcacatttagcccaacattgaatattgcttttatcaggtaacgggttattaggcattgggtagtgatagggctctaatggctccggtttggtagtacttaatggcacaatggtaaccaattcgctatttttcttgtgctttgatataacgacaacaggacgagttttcaccatttcaggggcaataaaacccgaaaaatcgcacattacaacggctttttctttaggttgatattttaatgccattttaaaatccttgtaataaaaaagccgtaaaatacggcttgaaagtgcggttatcttaatcctaattggcggtgggtgtcaatatcaataaattatataaataatacttgtattttgtttttattatttatataatgaacttgttttcggaatggttctgaaaatgagaagcccgactgaaatcgggcatttaaaaaaggagctaggattatgttttggaaaatcgcaatcctagttatcttgttagtggtaagctcaaatgcttactagttaatggataaccctgcgggggatatgtgagagtgtcccccaacggctcctaatataacaacttcagttttaaaaatcaaccaaaggtaataaaaatggcaaacgctcaaacagaacattctcgtaaacttcgtgcggaaacttcacgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaaattaaacccctgcccgtgtgttacgactttttcgatttcttcgtagcggcggacgttaaatttctcaaactctaatactttgactagrctttctgctttagccttgagttgttcgagttcttgctgttgtttgaaattctgtgcgacaagttctgaaatgtgttcgtttgctcgaataacggcaagggcttgccgtgagcagagtgttacataatagtttaactgcttacgcagtttgaaaggattgagggttttcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagttagttaagaattctactttgagcaacttcaatcagtagtttgtattcgtgatgggtcttgtcatcgtggacttcttttgattttgataaaaactcgtccaccgtgcctgtaaagcaaccacgagtaacaattaacccaaattttccattaaagaccgtaagcgttccattttctgaaccwacattacttgcccaaaaaatcattttgcgttcagagataactgcaaaagatctcacccgagcatcaccgaacacccragcnwtaycgtacacccragcatyaccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaagggcgttgccattaattcactttcaacgccttcagcgtttcaataaattgcggaatgtacttatcaaaggctttcatcaacacaggatcggggttttcggtgtggataaaaagcgtttgtttttgatattcagggcagtagctgacaaaatcccaactgtcataacccgtaacccataaggcgacttgtacctgtatgatgtactcrctgggtaccacgccctcaatgatatatttgatgtgggttttcattttggggcatttgatttctaagccttttcgtaaggttgggataagtccatcggggcttaccatcatatctttgtcggcattgcgatatacaccaccaacctgaacaacatcattgcctgtggcgaaytcatacgccattcttgcttgttcttcaagcwgattacctcgcaacatatcrstggatttaaagccttctgttaagccctcgatactttctgcgaccagttcggcaaggtagcttgtccacgcacttgattttttaccgcttggggtgacgatatttgacacccctgttgcagtaggaatacctaatcgtgcggtgagccattcttctgtgccttgctcacagttgagtgtgattaggttatctatcatagtggtatgttttcccctaagttttcgctttgagcctgtgacttatcaacacgttcattcaagattttgattaaatgttcggctttgtctttcggcagctgatcaaggctgtttacgccataaaacgcaagggctttggcaacatcggtttgggtaatttggataagttgatcgagttgttggcgttgttcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcgagttgttggcgttgttcatcagtgatcctaacaacgccatctacatcgattacggtttgttgtggtgaagctggattaataggctcttcagttatctcatcagcagtgattacaccgcccaattcatcaggaaatgctttacgcaatgcacccgcttcagcacatttagcaagctgccctcgagggcgtttcgtccacattgaattaactttatattttcctgttcgttgtttgccttcccatatttctgttattgcacaggcttcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcacagcgttcaccattaacaaaacgataaacagttactttgcaccattcaggagcattcacaccaagatattctatagtatcgccaaatacaggatcatcttgccctgccatttgcctggtacgaaatgctgtaattcgttgttcataaatacccggcataattacatcacgccattttttttctcctgtttttgcatccgttacgctcattggcacaatatgacaaggtttcttgagaatatccattttacgagccttgcaataatcaatcgcaagtaaaatactttcgtctttcgcaccagggaaaatactgttttgtaacgtattccatattgcataatctatgccacgttcagaaagtgcggtttgaatgttggatggtaagtttgttgtcataatttatccttattttgctttattaagtgaaacacaatccccaaatctccctttaagctcacgagcaatattaacagcttgggattgaatggtttgatttaatcgaatggttatcacaaaatcccctaaaggctctgtggtttccgtttttgcaaaatcctgtggattttcgaccgcttgttgctgtgccatttcatctgcaatagcttttgcctcmgcttgmactttttccgcytcrgcttttgctttagcctcttgttctgccttggctttaatttccgcctctctctgttcttcttcggcaatgcgttgctgaatgattggctctaactcttcttcccctgcaatcaacactaaccagtctttaaacaggtattcgtaatgaataggaattagctttctgcgtgcggaaattcgagctgcctcygctccgayttctgcggtaatkgcggtttcttcggcgttcaccgcacttgttaaagttgccagtgtacttctacgyttrgtygcwtcttcaaggcgttttttgatattttcctttggaatattacgctcaagggcaagcgatacatcgctttcgtgactgcctttgattgttaaaattgacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacacaaattgtgggagaggctccttatctggtcaagcatctacagaatcatttactaacggttcatataacttaagcttctttggaccaaacgctgaagaaattggcggtaaaatgtcattagatggtaataactacggcttagcaggcactcgcggcgaaatccaaaaataatttgatattgtaggtcgggcatttatgcccgacaccccaatcaataaccatttgtcgggcataaatgcccgacctacattttatgaaatcatctcaatttccttttattcttttatttgtaagtccgatacttttggcaaatccttttgctgatcctgttagctttgaacggttgtcacaagcggtcggttttgagcaaaaatttgcaaaaaaatcggcggatctgaccgcttcccctaaaacctctttgccattggcgaatccgcaaagccttgaagctcaaataaaccaagcgattatcgaacaacagtggcagcgtttaccgacattgttacaggcttatcagcaacaatctcattacgatataacccttgttcattatgctttaggggcattttattacgggcagcaacgttatcctgaggcaattgaacattatcaagcggttttagcgcaacagccgacattggcttaccctcgttttgatttaggggtaatgctttacgaaaatcagcaataccgccaagccactgaacagctgacaatgacgaaagcaaatttagacccgtcaatgcaacagctgactgaacgttatttggctagaatggaggaagagcagagttggcaaccggatttcagcctacaatatgtgcgtaccgataatgtaaataatgcgtcatcttcgcctgtggtgaatatcaacggacggcaatttgtcaaagatcaagcctccttaccgcaatcagcagaaggttttcgctatggtattggcgtatcaaaagcccataatttaaccggtaatcactactttaacggttcggttcattacagcggtgtttactactgggataatcaggattacagcgaacaatcgctccgttttagcttgggctatcaatatcgcaatgccaaaatgggcttaggcattacgccttttattgagcaaaattggttgggtagcccacgttatagcagactattcggtgcaaccttacacggttatcgctacttaacgccaaaatggatcgcttcctctcgtttaacgcatagtcaaaaacgttatcacgacagtttaactgcaagccgttatgacggttttaaaaacagtggagctttgacattacgttggcaagcggtcagatcttggcaaatttttgcaagtattgaagccaatcgagagcaaactaaagaaaaagcctcttcttcccataaaattgggggaacgcttggtgttatttaccgttggaaaaattggggcagcgaactcagcggaggctatgccaaacgcaattttgaagggaaacattacctttacggctataagcgtgtcgataatgaatatcgggcgaattggtcattgtggaatgagcagtgggcatggaaagggttaatgccgaagctgaattttagttatgtgaaaattcaaagcaatatacctgatttctattcaagaaaaaatggagaatggtttttgacggtggaaaaacggttttaggcttgatttcctaccaccacataatccaacggctcgtcccaactctccaacggcaaatattccaactgctgacattgatgagccaacccaacgctgattaactgcttggcttgagaaagggtgcggtcgtaaaagccgccacccataccaagccgattgccttgtgtgtcacaggcaaccagtgggacgaagatcatttctaattcattgagtggcaacacatttcgtacatctaatttgggctgtaaaatcccaaaacgatttcgctctagctgtggttccccttgatattggagaaaaagcagttggttggctgaaaaggggtgtagcacaggcagatatatctttttgccttgcttgataagtctatccatcaacgcaagcggtgagatttcaccattaaatggcaaataaaaggcaatatgttgagcggaatagcgttcaatgagtgctaatgattttgggataatatcttgtgccgcaaaggcttgttcatcagcggttaaggctagacgtttggtggagaaatattattcataaaaaagacccgaagtgccgttatcggtggtggtccttgaaccagacggttcaagggagtcgaacattatcatttttaggcttctcgtaaacgagcctgctcaccaacgatataagagctcaactcaaagtgttttaaatatcggctcagggacgtaactaacaacgcacacctcaggcaaagagaatactaacggaatttgctaatttttcctagtgttcagatcaataaaatcatagaaattcgctttattcgttattttcttgaccaacagaaaccgaatccatcccactagattggaattttgcaagagaactatctagttgctctacgcacgccattaacacatttttgttttcagcatttttgcgttgttcttgttctaattcatagttgagatttaaggcaacgatcgacaacactttttcaagctgaataataccagattgctcttttagcactgccactcgatcttctaaccgcttggctgaagccaataacgcttcttgttgttctggcgggcagtataaacgtagcacttgtccaaagagcgataattcaatgttatttttcgacattgttgagaaatccttacgaacacaaaaatttttgctattatgccaccctttgaacaaatcacaaataatctaatatggcaatttcacaatcaaacgactttaaacaactgatttctgagttacaaatcgactacacccctgctgagtttcacggttttttaagtggattaatcgctggcggtattcaagatgagtcttggaaaacattaacctatcaatttaccaatgatggacacgcattttctcaagctccacttgcaaaattaaccaaattttatcaacaacttagcgaaagttttgatgaaacgaatacgcttttttcattgtggttaaatgaagaagacggttttgcaatggcagatggtattgctgaatggacagggcattttttacttgggttaggtttagcacagcccactttacagcaagaaaccaacgaagttggcgaagccattgatgatttagatgaaatcgctaaattaggttatagtgaagaagataaaaatgatgaattgctagacgctggcgaagaaattattgaatatctacgagttgttacactctttttacatagccatttcgccacacctaaaatggcggaaaagccaaaggtttattaatatcaggggcatatgccccttttattatgccgcttggcgatgataatgccttaacgcctgctctttttgacgggcggagctaaaagatgaaatcctttttaaataaccaattactctagtagcgtgatcgatgtctttagaaccacaacagctacattgtgaaagggggcgtttatcaatatggtcacaggcattacatagggtgattttcacattgatacaaaaatagttacagcctgtttttgccgcaatgtctaatagtgagcggtagctctgctggcttaaggcttcttctaaattcagatgtaatgccgaacctccatcgaggtattcaaccaacgcttttccgtgtaataggaatttatctaacgcattgatttgttcatcttccaccacataaaaataagagttatagcactctctcggtacaacatagcccgcttccctgtcccatttcgcatttttcacccctaaattttccgcagggacaaattcggtattaaatttcacgccgtaggttttgcaagcggtctgattggcttgataaattgcaaatagtcgctcacgcacaaaatcaatatattctgaattgtaccccaccttaatgccccgaaactctgccgcttcgaccattccgttaataccaattgtcaggaactgcttatctaatgagataaacccagcatcataaacaggtaacattccctcattgagataatcttccattagctttcggtaagcatattgatattgatggatcttaccgacttctgtcactaaatctcgtccatcttgctccaaacggttcatattgagtgtaataacattaattgagcctgttgcaacgccaccagcccctaaggagtaagaaaaggagtgatcggcaatttcattgcgtaaacggcaacaagatgcaagcgaatcaggattatccgattgataaataaagaaggaatttccttcggataaggcttttgccattttatcggcaaaatcactgtctttgcatttgtcattttcagtcagcattgccgctgtcacgactggaaaggttaaaatcgcttttgtccgctcttgattaaaccactgcataaagaaatcttgcaacgctgatgtggtttgccaattcggtgcggtgagatcaggaaagacaaaattgccgaacatcgcattaaaatagtaatggtcgtaaatggaaatattccaaaagacactttgataaccacgagcggcagcaggttgattaatgctatacaccacttgctgtaaatggttggcaatttcgtgttgatgtgtttgaagataattatcaccataatccttacgagcaaaatagtcaaaataggtcaaaaactcgacggttgccactgcccctgcaaattgagagctaatcgcaaagacaaggttaataaaagatccacaaaaagaggcaagatgttgtggtgctcgagattccccacccagtttggttaaaccgtctcttaaaaaaggataaagtgttaccgatacacaataaggcttcagactggtttcatcgtgaacatagatttcgtgtgcttcaatttgacgcagatattcgtccgcaagggattgaccaaaaatctctgcaattttaccgcttactttggctcgattgatttgtacaaagaaatccttcatcaattcctgttccattgttgctaaattcttttgggtaacattagcgttagcgtccatttttgaaccgtccgctgcatttttagcgtgaatgtattggtcaataaaatttaatttgccgagtagttgcgagtgttcaagtctaatcattgtttatcctgtctaaaatgtgcatttagcacttcacctgtttgaagattaataaatcgttggtttgtggtaatacaatttaacccgccaagttcagcaatccagcgacctgttttgacatagtccaacactgctaaaatctctggtggcagttgctcaagctctaatcctgtataaagacaagtttttaaaccagactgacgaacaagctgtaaccgttgcaataacaattcaggcaaccattctccccccataaacaacacacaactaatcagcccttgatattgcgctaatcgctgttgtaagtaaatttctgagagaaactgaccgcttccaagtttccaactttctatgctgtggcaacctttacaacctaaaggacaacctgaaattagaaaagctaaagaggtttcattggggacttcttgccacacaatctgttctgaaataaaacggatctgtttcattatataaccactatatcttgtggttttaaaccattaaaaacacaatatgtagtagtttatgcattttaatgtaaagggaattgataaaaatcaaagtgagtgaaatcactttgataagctcaaaagaaaaggaagaaaatcaaaaggatagaaaatgtaaattttttcgtatgattaatgccccagccaatttctcaacatctgttccccgtattccgtaataaaagactcagggtgaaattgcacgccatagatcgcaagagagcgatgtttaactgccattaatacgccttgatcgcaagttgcagtagcaacaagcggtgtgttttctaatgatttttgcgaaattgcccaagaatggtataagccgatattgaattgcttcggtaaatttttaaacaatgggttggcttgttgctgaattaatgggcgttgctgtccgtggcgaacttgattaagattgtaaagttcaccgccaaaaaattcgcacaaagtttggtgtccaagacaaacccctaaaattgacttatgttggtgataacgttctagcattgcaaatagttgtggatatgctcttggtacatcaggacctggtgaaatcataatatgactaaaacgttccacatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaactcttccaccgacaccacctgcatttcaaccccgattttgcgtaataaatcaacaaggttaaaagtaaaagagtcgtgattatcaataataagcaacattaaacattatcctgtgttatcggtttttcaaccagtaaatgtaaacgagtcgtatcccaatcagtttcaagcaattcaacttgtggggtagtttgctgtgcttttgcagaaagctgttggaaacgctcgactttgcctagcaatccctgtttaccgaccagtgctgttacactttggttatattgattgcttgcagtattcaaggtattacccaatttagcaagacgctctgcaatgacgcaaacctggttataaatatcccctgctttttcactgatctctcgtgcctctgcattacctcgctcaattcgccataaatttgcgactgtgcgtaaaatcggcattaatgttgtgtgagaaaccaaaatgacattacgttcatagccataattaaagagctgtggatcgtgcttcattgcttcaatataagcaggttcaatcggtacaaacatcaacacgaaatcaggactttttatcccaatcaactggctataatttttcttagacaatccatcaatgtgagtacgaagtgaacggcagtgttcatcaagtgcttgttgaattgcaaaattatcttcggatcgtaccgcttgatcgtaggcaattaaggaaactttactgtctaaaatcaaatgcttatcgtcaggcaacttcaccacaaaatcaggagcaaagcgttttccctcttcatctcggtaactctcttgggcaatataatgttccccagccaaaagccctgctgtttgtaacgcactttctaactgaatttctccccagtttcctgcaattttattattgccttttaatgccgtggtgagattttgtgcttcctgtgacattgacagcccaatctcaagcacgcgtttgatctcagcccctaaatccgcattgccttttattgcttcactatgcacctcattgacacgtttttggaaactttcgatctgctctttaaaaggcttgagcagtaagtcgagtgctgactgattactctcagaaaaggatttactcttttcttccagaatttgttgagcaagatgttgaaattcaacatttaactgctggcggacttctaggaaattcttctgttgagtttcaaaatttgcctgtttttccgaaagtgtcgtgcgtaattccgttaattcttgctgtgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaaaatttagcctgtaactgaccgctttctgcttgctgatgttgtagctgtaactgagtttgttgtaactgttcttccaaactttccgctttagtctgagccgaaccgatccgctcttttaattcattaatataacgttctagttggtcttcctgtaattctgcctgcttaagctgttgctgaagtttttgaatcgctaaatctcgttcatttaaacgctcaagggttgattctgcttttgtctgttgctgaacggcaaattgttctacttgatttttttcaagggaaatttgctcatatttttgcgagagcgttgaaaactgctgttgcaattgttcaagatcctgttgtcgttcttgactatctcgttgtgaacgggaatagctaaaaaagagccaaagtgagatcaataagagtaatgctatcgttgcataaagccaaattgggtcgagattcataggaatatatactgtaaaaataactagtgttattttaacgagttttgctgttaaaaagcaagggggaaaagtagagtcagaatgggacagatgtgctctatataaaaaattgctacaatagcccactattatagccttgcctatatacaagctatcattttttacaaataggattttatatgacccaatatctttcaacttcatttccagctcaccgccctcgccgtttacgcaaacacgattttagtcgccgtctagttgctgaaaatagcttaactacgagtgatttaatttaccctgtatttatcattgaaggggaaaatcaacgtgtaagagtgccttcaatgccaggtgttgaacgtttaactttagatcaattactgattgaagcggaattattagtcaaatatggtgtgccagctatcgcacttttccctgtagttggcgatgcaaaaaaatcactgatggcagaagaagcttataatcctgacggtttggcacaacgtgcagtaagagcgttaaaacaagcctttggagaaaaattgggcgtgattacagatgtggcgcttgacccatttacgactcacggacaagacggcattattgatgaagatggttatgtggtaaacgacattacgactgaaatcctagtgaagcaagcgctttctcacgcacaagcaggcgcagatgttgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccaagtgatatgatggacgggcgtattggtgcaatccgccaagtgctagaagctcacggttttatcaatactcaaattatggcatattctgcaaaatatgcgtcaaactattacggacctttccgtgatgctgttggctctgcgggtaacttaaaaggtggtaacaagaaaacctatcagcttgatcctgcaaatggaaatgaaggtctgcacgaagtcgctcttgatattcaagaaggagcagatatggtgatggtcaagccaggtatgccttatttggatttagtttaccgtgtaaaagagacttttggtgtgccaacttttgcctatcaagtatcaggggaatatgcgatgcatatggccgcgattcaaaatggttggctcaaagaaaaagagtgcattatggaatcactgctttgttttaaacgtgcaggggcagatgggattttgacctattttgcgaaacaggtagcagagtggttgtatcaagaaaagtataaatgagctgagttacggagaacatggcgctactattccaataccttccatatggaactttaattttgaagtagaattactggacattgcccctatattgcttttaactctatactattatttatgattgatggaatgtaaaatttttccaatctgaatattgggtagaataattaaatgaattaataaaaattctggtatgtcaggaaataaaatgcttatgaatttgctacatccaaccgatttaaaacagtgccaactcactcatcttcattccttcactaaaggaatgaccgtatataagcaaggcgaaaccgctaaagagttttattacgtcaatagtgggcttatcgggctttatcacaccttagataacggcaaagagagccttgttcgcctatatcaaaagggcgactacttcggttatcgaactttgtttggcgataatggctaccattgcaacgccaaagttttggttgaagcagagatcattcggattaagcccaaagacattgatactttcttcgtagaaaatccacagatgagcaaatttttgttgcaatcccttgcaaatgaactgcgagaagcggaacaacgcttggcaaaaagtgcctatttacgcacccttgatcgtgttatcgacagcatttattttctcacggaaaacttcccttactataactggacgcaccgtgaaatcgcagaatatgccggttgtgaaacggaaacggcgatccgcattactaaagagttgaaacgcagcgggttattgcaagattggcataaacagaagtaggtcgctatgtttgaaaacgcccccaaagcccactttcatttgatggcaaagccaagtagctttcaatgcaacatcaaatgtgaatactgcttttatcttgaaaaagcacataccattgagcaagatgtacgttttatgaatgaagacaccttgcgaaattatgtgcgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcaagaatttgcaaacggtaaaacgatcaccaatgctttccaaaccaatggcattgcactaaatcgccaatgggcagaatttttcaaaacacatcaatttttgattggcatttcgattgatggtttaagtgaggtgcataacaaatatcgcatatcagtcaatggtcagccgacctttgaacgggtcaaacgagcggtagatttattgaaagactatggcgttgagtttaatacattgacggtgattaacgatcaaaattggcataaaggcagagaaacctaccttgctttaaaagagctgggttcaacttttatgcagtttattccgattgttgaaacaggctgtggcacaacaccttttgcaaaaaaggacgcaaaaccgaccgctttctctgtgccaccacagggctatgggcattttttgcttgaagtgtttaaagagtgggtgcaacaggatgtcggcaaaatttatgtgttggaatttgacaatctgcttgggcaatggcttggctacccgtcaagtagttgtgttcatcaggagagctgtggcacatcactgattgtggaagcaaatggtgatgtttattcctgcgaccattttgtttatccaacctataaagtgggtaatttaaacgaacagccgttgggcgagattgtgcattcccaaccacaatacmaatttggacaacaaaaaagaactgcactcactcaggcttgcttagcttgtgatgtgcgaacgttttgtcacggcggttgcccgaaacatcgaatgattagcttgccaaatgaagcaaacaaacacaactacctgtgccaatcctatcaactctttttccgaaaaaccgccccatttatgcgaaaaatgcgagatattattcgtagtggtggatcggctggggatattgtgaattttattggcgataaagatgctaacaagaatatataacaaacattattcattggataaaaaaagaatacagccatatgacctttatgctaataaaagagttataaaaaaggtagtcctgaggtcagctgaagaaagaaaaatcttatatttatcaatgagtttctaacctttatctaaaaaagaaggtgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtttattttctctaaatgttagcaacacttttgtctactatgccttttaagttaactactcacaatcaccctcaagctatccaatcgccaatttgcttggtctagatgtttcagtgatgcttctcgcaactgctctagggcttgaatttcatcagcacgaatgtttttattcactgcttgtagtgatgtcaagcggtgtaattcagcacctaaagtgtgatccgcattctgttttgcctgttcaattaaggattgtgcctgtggtacaactttttcatcgctgaatgcaatcagcttctcaatatcaccacgagccatcttcgcaattttatttgccatctgtttattgaccggcttgagctgtttttccaaccctgcaaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacctgcgatgccatatcgttgcctttgttatccagcaagatacgcacaggcgttggcggtaggaaacgggtgagctgtaaatcttttggtgcttgggcttctacgatatagattgcttcaagcagtaacgtgcctgctggcaagtttttattaacgagtaatgaaacagcactcttaccaatatcggcggacgtaataagatcgataccgttgcggatcatcgggtgatcccacgttaagaacaacacatcttctcgcattaaggcaagttcacggtcaaaagtcacggtgttgccttcttcagacaagcctgggaaatcaggcacaagcatatgtcctgtcgggctaatcacaatgcttttctcgcccaaatcttcctgctctaagccaattacatcaaataaattcaaggcaaaattgaccaactgcggattgtcgtcttgttcagcaatagcttgagctaattgttgagcagtttcaccgccgttcgagttgagttctaacagacgatctcgccctttttctaattccactttaagctgttgttggcgtttatgggtttgttccacaaaggcttcgaaggcttcgctacgttcaggattgagtaggtaagcggtgagttccgcattaaattctctaaataacgttgcccccatcggacaagtttcttcaaaggcatttaagccacgatgataccattccgccaagatcaactgggtggagtgattgaaacaaggcacatagatttcaatatcgtgtttttgcccgatacggtctaaacgcccgatactctgctcgagtaagtctggattatcaggcaaattaaacagcactaaacggcgtgcaaactggaagtttcgaccttctgaaccgatacttgagctaatcagcacctgcgcgccatcttcttgttgagcaaagtatgcagaggctttatctcgctccacaatcgacattttttcgtggaacaccgcagagcgaatagcttctttttcacgcaacacttgttctagctgaatggcggtatccgcttgcttacaaatcaccagaattttttcatcacgatgatttttcaagaatgtaattaaccactcaatgcgtggatcaaactcgtgccacttcgcatttgggttcatacgttggaataggcgttcagggtagagcagatcttccatcttatttccccccatcatacacattactttcaaagcatttgcatattgtgtaggcatttccaacacaatttcattgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgctttgacgagtattgcggaatagcacacggcttgttccgtgtcggtcaattaactcactaattaactcttggcggacttcccgacgctgttcttcgctagcatccgaattaataatacggaacatcggctcaacatcttcttccgccagcaattcgctgatactttcctgctctttggcacttaacggcttatcgttaagcaaggtagcgacagcatcggcgacaggctgatactgtttttgctcttccacaaaggcttgataatcgtagaaacggtcaggatctagcaaggctaaacgagcaaaatggctctcttgtcctaattgctcaggggtcgccgtgagtaacaagactgctgaaatctgcttggagagctgtgcgacaaactgatatgccatacttggattttgctcgtcccattccaaatggtgagcttcatcaacaatcaacatatcccaatcggtatcaagcacttgttttgcacgctgtggatttgccgataaccaatcgatagaggcaatcactaaggcttccgtttcaaacggattttcactgatgtcgttattatcttcatctttcttagtgaaatcggcacaacgttcctcatcaaacagcgaaaaattcaggctaaaacgacgaagcatttcaaccagccattgatgctgtaaactttccggcacaagcaccaatacacgatctactcgtccggagaaaagctgttgttgcaaaatcatacctgcttcaatggttttacccaaccccacttcatctgcaagtaacacacggggagcaagacgttgcccgacttctttggcaatatgtaattgatggggaattaggcttgcacgaataccacgcattccacgcagttcagattgaaactgggcttgttgatgcttcaaagcacgataacgcagggcgaaacgatcactgcgatcaatttgggcagagaatagacgatcctgcggtttactaaaactcactttatgatcgagttgcatttcaggcagaacgctctctacttgagtatcgacacgtttacctaaatagagtgcaaccccttgattttcaacgacatcttcaatatctaactgccagccatcaatactggtaacacgatcgcctttttggaattgcacacgggttaaaggggcaacggcaacagcgtacacacgttgttcgtccgatgcaggaaatgaaagggtcacagtgcggttatccactgcagtgacaatgcctaatcctaagttattttccgactcactaatccaacgttgtccgactacaaagctcaaacttacctctctgcggttctactaaaattttcggagactatctgatcttggtggagtaagcggtcagattttgccattattgtttccataatttgaactgattaatcaaaccattcgttgaactgtcgtggctagtaatggtttcgttattttctagctctggcaagatacggttagcaagttgtttacctaactcaacaccccattgatcaaagctataaatattgaaaattacgccttgaacgaagattttatgttcatacattgcaatcaacgctcctaaggtgaatggggtgattttttggactagaattgagttcgttggtttgttgcccgtaaatactttaaatggcacaatttctacaacttcttctaaagatgtacccgcttgtaagaactcttgttccactacttcttttgacttaccaaaagcaagtgcttcagtttgtgcgaagaagtttgaaagcaatttagggtgatgatcgccaatcggattatgggtttgtgcaggtgcaataaaatcacaagggatcaattttgtaccttggtgaattaattgatagaaggcgtgctgtccatttgtacctggttcaccccaaatgataggccctgtttggtaattgacaaattttccatctcgcccaacatatttaccgttagattccatattgccttgttggaagtaagccgcaaaacggtgcagatattgatcataaggtaaaattgcttctgattctgcacctaagaagttattgttccaaataccgataagggcgagtgtcaatgggatattttgctctgctggggcattaaggaaatgtttatccattgcgtgtgcaccatcaagtagttgctcaaagtgttcaaaaccgatagaaagagcaatagataacccaatcgcagaccagagtgagtagcgtccaccaacccaatcccaaaattcaaacatattttctgtatcaataccaaatttagcgacctctttggcattcgttgaaagagctacgaaatgtttcgccacagcagattcgtcttttgcagtatccaataaccattgacgtgctgaaagagcattcgtcattgtttcttgagtagtaaaggtttttgatgccacaaggaaaagggttgtttctggattgattttcgctaaggtctcagcaatatgcgtgccatcgacattagaaacaaagtgcattgttaagtgatttttgtatggacgtaatgcttcagtgaccatatatggacctaagtctgaaccgccaatcccaatgtttaccacatcagtaatcgccttgcctgtgtagcctttccagtcgcctgaaatcacacgctcacagaagcctttcatcttcgctaaaactgcattcacttctagcatcacatctttgccatctacttcaacaggggtatttgagcgattgcgtaaagcggtatgaagtactgctcgattttctgtacggttaattttttcaccattaaacattgcgtaagtggctgatttaacttggcattcatcggccaatttacgcaatagggaaagggtgtgttggttgatcgcatttttagaaaaatcaacgagaatttgatcttcaaaacgtaatgaatatttatcaaaacgttttggatcttcattgaatagctgtggaatcgtcaaattctcagctttgtgctgttcaagggcattccaagcgaaagtttgggttggattgatgttttgcattgaattatcctctaaaatttaattttgtgattcagttgattgtgttgagcttagttcatctaagcgtttttctaattcattcaatttttcacgggtgcgaagtaaaacttgagattgaacttcaaactcttcacgagtaactacatcaagtttagcgagttgggcttgtaagatttgtttaaatttttcttctaaatcattgcccacattttttaaaccttgtggtaatgcattgtgaagttgctgtgcgagagattctaaattttttggattaagcataatgttccccttgtaaattagggcattaattctaaagaatttcagtaaagataaaaagcaaagaatagagagaatttaaaaaattagagaattattttatctagagaaataagaagatggctggggtactaggattcgaacctaggaatgctgggatcaaaacccagtgccttaccgcttggcgataccccaaaagaaaaaaaactaacttgcgttagttcattcgatttgaaataagatggctggagtactaggattcgaacctaggaatgctgggatcaaaacccagtgccttaccgcttggcgatactccagtcgttttatttgcaagcttaaaatggtgcgggacgagggacttgaacccacacacctctcggcgccagaacctaaatctggtgcgtctaccaatttcgccagtcccgcaaatggtggctacaacgagattcgaacttgtgaccccaacattatgagtgttgtgctctaaccagctgagctatgtagccatttgcgtcaccatatcggctttgcggggcgtattatgctgatttcactctacctcgtcaaatacttttttgaaaaaagtaaatttttctgcttgtttgactagagattcggcaaattgtcagaaaaaacaacaataatctctataaaagactgattttataataagttaacgattgccgttttaaaattccatttcttgttttatctgttttaatataggttcaacatctggtaatacatcttcccacaactgaaacgcataagccgcttgtccaactaacattcctaaaccatcttggtattgtgttgccccttgtgaacgggcgtattcaagaaatggggtctgcatatttggagcatattgcatatcataaatgttggcttgtgtaagtaatcgtgctggcaattcgacgcacttgccttgcaatccaagcgatgtcgcattgataattaaatcgaacgactgttcgggaagttcatcgaaacaagcggattgaatttgcccaaactttgcaaacttttcagctaaactggccgctttatctgccgttcgattgtaaatggtgatctgctgttgagcttgtaataagggataaagcgcgcctttggttgctccaccagcccctaaaatcagtatgcgttgatgtgggttaagccagcctaaacgggcaagatcggatactaatccaacaccatcggtattgtccgcatataaacgcccatcatctaaccgcttgagcgtattacaagcttcggcttgtaagcaactttcgctataaatatccgcaagggcaaaggctctctctttaaaaggggctgtgatatttgcacctttagcaccttccgcaaaaaattgtttgagttgctgttcaaactgttgttcatcgcctaatttcgctacgtaagaaatcgctttgcccgtttgttgcccgaaaagtgtatgtattcttggggatttgctttgtgcaatcggatttccccaaactgcgtactggttcattgtctatccttgtcgaaaaatatgttggctaaaaatgtcacggatttcagacggatttgactttccgcctgtggcttgatctaatactgggaacgatttgccaaattgctgtcgtacttcgtcggcagttaggcaaggtgggagtgtcgttaaatttgcactcgtagaagtgagtgcaaagcccgtcgctgtacaaagctcgacaacggctggcacttggcataatcgcacagcaatggtgtcaaactgccctttcagataacgtggaactgtggctttggctggcattatccaagtaattgcctgttcgcctagcgtttcaaaacgttgccattccacctctgtcaaatgtgtatcatcaatgtagggtagaagcagttttttattatgggcaattaaaatcagccctttttcttctggacgattttttaattgaagcagagatcttaccgcttgctcgctttgcggattgcaacctaatccaaaaacggcttcagtaggataggcaatcacttgattttgtttaagtttgtcaataagttgattaaaagaatacattattcgctttcactaaatagatgctgacattttctgtttgcacagagaaaataggattttccacgcacttttttgatggtggctaattcacctaaacattgtggacattgttgctttatgggcttggttggcaaggtaaatttacactcaggaaagcctgaacagccataaaatgttttacctgaacgccctgttcgtgccactaatttatgtttctggcattcagggcagtcaaattcttcctcgatttcagcttcttcgtgtaccgtaaaatggcagtctggatactggctacaaccgataaacataccaaaatgcccctgttttaattgcaatggcgattgacattcagggcattgttcatcaagggttttgatgatatggcttgcttggtggataggtttgaggtaatcgcattgcggatagctactacagcctaaaaaaagcccctgctttccccgttttagttgtaatggagaatggcattgcggacataattctgtctgtttcgtggacttaaaaaggctcatttttaaactaaattaactcaaattcaatcacaaaaaagtcgttatggttcgggtaaatctctttgattacttgttttagttcggcaagtgtcatattttcttgtttagcgtgcgtatcattgagctgttcaaactgaataggggtaacagatagtacacgaatatgagcaaacaagcggtctgtttcatttgtaaaaacacttaactcttggcccgcttgaaaatagctttctgacttatcacgaatggtaatggtctttttaccactgacaatgtctgcttcaaaacgactaaaaaaagtaatcttattcatcgtagtcaccataatctagatccaataaatgcctaaaatgatcgttataaaaaccgtggctcaccatatatcgccacattttttgtttcgcttttatatcccaatgtgatggtctttttttctcaaaaagccgttcggcaagttcaaaaaaatcgacttccgcttcatcaatggcttggctaattacccactcttttatacctttgagctgtaactcttgttttagacggcgtggcccatagccttgttgtgaacgatagcgaacgtaactgatggcaaaacgttcatcactttgccatttattcgcttgagcctgttcaatggcttgctcaatttcttgtgtattatattctttaagttgtaatttgtggcgaatttcagcttcgctatattctcgtttagaaagtagataaagcaaatagctattcgcagaatatttatgtgtcatttatttaccgcagtaaaataaaaatgcggttctcacaaaccgcattaagttattatagttcttcttcgctaaactcttcgacatcgctttcatcattgctgtcgcttgccgtcgcttttaatacgctatttgggtttgacgccaatgtatttcggatctcttgttcaagtttatctgcaatttcagggttctcttttaaccatttcactgcattatttttaccttgtccaattttcgttccgtcgtaagagaaccaagcacctgatttcttaataaagccatttgcttcagctaaaatcagtagctcattcatacgagaaatcccttcgccgtacataatatcaaattgtacttcacggaatggcggtgcaactttgtttttcaccacttttactttggtttcactaccaataatttcatcgccatctttgactacaccgcaacgacgaatatctaaacgaacagaggcatagaatttcaatgcattaccgcctgttgtcgtttctggattaccaaacattacgccaattttcatacggatttggttaataaagaccactaaacagttggtatttttgatatttgcagtgagtttacgcaacgcttgtgacattaaacgtgcttgtaagcccatatgcgagtcgcccatatccccttcaatttcagcttttggcgtaagtgcagcgacagagtccacaataataacatcaactgcccctgaacgaactaacgcatcacagatttcaagagcttgttcaccgttatctggctgagaaatcaataaatcatctgtatttacccctaaattgcgagcatagacaggatctaaagcgtgttcagcgtcaataaaagcacaggttttattgcctttttgagcttgagcaatcaaagaaagtgttaatgttgtcttacctgacgattctggcccatagatttcaacaatacgccccattggcaagccaccaatacctaaagcaaggtctagccctagtgagcctgttgaaacagactcaatatctaattgctcagtctgccctaatttcataatagagcctttaccaaattgtttttcaatttgagctagtgccgcatctaaggcttgttgtttctgttctggtggaacttgtttaatgacggtattgttttttgaagattttttattctcagccataatgctttcctttgttcattgtttggatagggcaaatgcattgccataaaactgtaaattattatactgtttaaccatacagttgcaactgtttttttcagtttttcgatctatatcacaaaatttacaactttatcgaaaaatcctatcgcttgtaatcggcactgccctttgaagatcaaaaggatttaaggcattaatcaccattatttgttcataatcaaaaagtgcttctacaggtatatcaattaagctaattttttgttcgtctaataaataacttagttgtgtaccttttaataaataatgatttgggctataccattttccttgttttaaaaaaagtaaattaccaatagagcaatcactaataaagccattattaacaagaataatttcatcaccagcggtttgttttaatttatctaattcaactcggtcagtatatttgaattgataatcaaaattttctacataaacgcattgaaagttttttattgctttaggtatataatggaaaaactgaacttgatgttcttttgtgttataatcaatacgacaacgtactaatcctttttgatatgcttcaggcactttaataatatctaacagttcaaaactattttcgtgcttaaaataatatataaatgcattattcattcgttgttgatgataaaaaatattttgtatcttaccatcaataattgctaccgtttcaaagagtggatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagagtggatattggcacataaactttctctaaaatttcattatattctccatctagctgacttaatgcagtaattccgccaccgctacgaaaataatatgtatccccttgtttttcaatatagcgaatagccaccgcactctctacattttcaccatcaaaataaccgaaaatccccgtataataaccacgttcttgttgttctgcttgttgaataatttcaacggttttcactttaggcgcaccgctaattgagcctgctggcaagagtttatccaacattgtgccaatattttcttgccaattttcatcaagttccccacaaatttcagaactcgtctgataaatcgccccacgatgtgtttccactttttcaacatagcgatatttcgtgacctgaatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataggataagaatagattttattcgctttaatacgaatgaaacactcaggggaaaaacagacaaatctttcatctaataacaatttgtatttagctttactttgctgaaaaatttgtgctaaatgataatttgttttaatttcagtttgctgagttaagtttaaaagataactattcccaatttggatctgttgttgaacaaaatcaaaggcttttttatattgtggataatcaggtggaataatctctaactcaaaatttccatttatttttaatggttgaatgaacttttgttgtccattaaaatcaaaataaagccctttatcttcaatttcagataaaggataaattaatggtttctgtttttcaaaatcaattaaaaagaaaaaaggcaaacgcatttttccatactgattggctagttgaataaattgttgcattttaatatttctattattcggagttaaaacctatgtcccattcacattcttatatggagacgcacgcccaacaaaataagactatcctattgattagtttagctattataacgacttttatggttgttgaagcaatctctggctatttctttaatagccttgccttacttgctgatgccgggcatatggcaagcgatagtttatcgctcttattgtcactttttgcataaccttgcaaaacgttttcacgaaatggatattcacgctacattgcaaaatgatttagccgtttattttgaacagcacggaaaaacagagagcacccaccatcattaactatttgatattaatcaaatagttaataaagaccgactaaaatagtcggttttttgttgcctttagttaaaaaaagcataacattttcaacatagtgcaactttggagaaaaatatggacaacttaatttgctataaacagatgccagtttgggataaggaaagcctaccacagatgtttcaagagaaacataatactaaagtaggaacttgggcgaaattaacaatcttaaagggatcattgaaatactatgaattaactgaggaaggtgaaatcgtcagagaaatgattttcgacgaacaaaaccagccaccttttgtggagccacaaatttggcataaagttgagccattaagtgaagatctggcgtgtcagctcgctttttattgctcgccggaagattatttcgctaaaaaatataatctcactgcaacacattctgaagtattaaatgcgataaattatctttcgacaggcaaagtgttagaccttggctgtggaagagggcgaaatgcactttatcttaacttaaaagggtttgatgtaaccgcagttgatcagaatgaagaaagtatccatttcctcaattcaatcatcgaaaaagaagatgcacaacatatccaaacgggtatttacgacatcaaccaagctaatatacaaggtgaatttgactttattgtttccactgtcgtaatgatgttcctaaatcgtcattgtatccctgcaattatcgaaaatatgcaaaaaaataccaaagtcggtggatataatcttattgtctgtgcaatgaacactcaggatttcccttgtccaatgcctttttcatttacattccaagaagatgaactgaagcagtattatcaaggctgggaacttgttaaatacaatgaagatttggggcatttacataaaaccgatgaacacggcaattgtattcagctacgttttgtgacaatgttggcgaagaagttggggtagatcgcgtagttctaatcttcaactcaattttatggcataatggaaactttataagaatctattgttatcaatgacaatagatttagaccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaataatctgaatctattgttatcaataacaatagattcttcgttttatacattatttggattttatcaatgcaagaaccttactatcgcgggcgtttttccgttgcaccaatgctcgattggacaactcgccactgtcgctattttcaccgtcaatttactcaacatagcctactttatagtgagatgattaccgcacccgcaattttgcacgcgaaatatgatctgcttgcttacgatcccacagaaaaccctgtggcgttgcaattagggggaagtgatcctgaacagttagcgaaatgtgcaaaattagtggaagaacggggctatgcggaaatcaatctgaatgtcggttgcccatcagatcgtgttcaaaatggtatgtttggtgcctgtttaatgggaaaagcggatttagtcgctcgctgtgtagaagcaatgaaaaaagaagtgagtattcctgttaccgttaaacatcgtattggcattgacgatctagatagctatgaatttttatgcgattttattgagaaaattcagctttactgtaacgattttattgttcacgcgcgtaaagcgtggctgtcaggtttaagcccgaaagaaaatcgtgaaaccccaccgcttgactatgaacgagtttatcaactcaagcgggattttccacatcttaaaattagcattaacggcgggattaaaacgattgaagagatcaaacatcacttgcaatttgttgatggcgtgatggttgggcgtgaagcctatcaaaatccgtctttgcttggttatattgatcaagaactgtttgacccaaacgccgatattgttacaccaaaacaagccgttgaaaaaatgctaccttacattgaacagcaactttcacaaggcgtttatctcaatcatattgtccgccatattcttggagcattccaaaactgtaaaggggcaagacagtggcgtaggcatttaagtgaaaatgcgtgcaaacaaggggcgggtgtagaagtggttgaacaagcattatcttttttgccttactagttgcaaaatctattaaatacttaacgactcaggtgcttatggtttattgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacattagcaaccattttgtctactatgcccctttatctactataccggattaaccattaatcatctaagaaactgcgtagagtttcggaacggctagggtggcggagcttgcgtaacgcttttgcttcaatttgacgaatacgctcacgagttacatcaaattgtttacccacttcttcaagggtgtgatcggtattcatatcaataccaaaacgcatacgcaatacttttgcttcacgaggtgttaatccttcctctaatacagcattcgttgcaattcgcaaactttctgctgttgcagaatcaagaggcaactcaagagagctatcttcgatgaaatcccctaaatgtgaatcatcgtcatcccccactggtgtttccattgagattggctctttagcaattttgaggactttacgaattttatcctctggcattcccattttttctgctaactcttcaggtgttgcttcacgtcccatctcttgtaagcattggcgagaaatacgatttaatttgttgatcgtttcaatcatatgcacaggaatacgaatagtacgagcctgatctgcaattgagcgagtaatcgcttggcgaatccaccaagtcgcataagttgagaatttataaccacggcgatattcaaatttatctactgctttcattaagccgatgttaccttcctgaattaaatcaaggaattgtaaaccacggttggtatattttttagcaatagagataacaagacgtaagttggcttctaccatctctttcttcgctttgcgtgcttttaattcgccatctgcaatgcgtccgccaatttcacggatttgcgtaatggttaaacctgttgtttcctcaagtttctgcaagtttgcgatatttacacgaatattatctacatagttggctaattttggcacaccaccctttttagcattgatcgctttatcaatccacgcctcagataattcattaccttggaatactttgatgaaatccgtctttttcatgcctgcatattctacagcatagcgttgaatttgacgttcttctgctcgcacttgcttcatcattttttgcatcgtttccactaacaaatcaaattgttttggcactaagcgaaattcacggaaaatatcggaaagtgcttgaatttgatctcttgaacgcttgctagtacgtccatgtttttggattgcttgtaaggctttttgatgttgctcttttaatagcgtaaatttctcacgagcaagttctggatcaatgctattatcatcaccaccatcgcctgatgattcaccatcttcactttcatcatcaatatctgcaacggtatcactttcgctttcttcatctagatcggcatcgaggtcatctacaggggtactttctaccgcattcggatcaacgaaagcggttacaagatcggataaacgtacagtgccttcttcaacttgatcataacgagcaattaattcacttaaggcctcagggtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattccttcttcaatgcgttttgcaatatcaatttcaccttcacgtgtaagcaactcaaccgttcccatttcacgcatatacatacgaacaggatcggtagttcgaccaatttcagattctaccgtagaaagtactttagtcgcctcttccactacgtcttcatcggcaatattgcctgcaagcatcaaatcatcggcatcaggggcagtttccagcaccttaatccccatatcgttaatcatttgaataatgtcttcaatctgatctgcatcgacaagttcttctggtaagtggtcgtgaacttctgaaatcgttaagtatccttgctcacgcccttgagcgataagaagttctaactgagattgttgttcttctaattgagagtattgttccatagctttatccgttcttaagagcaaaaataagtagtggattataccactgcttgaggtgcgataaatagttttgcaaaaatttataagtatttgaccgcttaccgcccagtcaataacatcattaattcctgtttttcctgctgatttaaacctgttgtacgatcttttgccattaaaatttcaatttgtcgatcaagcagtttcttatagaaaaaatcaagcgtatcaataaaagtgttttcgacattttcaggggataccaagtgatcccaatttgccagcagttccaagtggcgatagtttggactctctcgcaaatgttccaatacaccgcccatcgaaatacccagattagcgtgacaaatattgactaattccagaaaaagatcgaaacctttttcctgcaaactctgtaaaaatgtcacatcttcaggcacattttgaaccaaatgaggattttgaagtagtaacgcaatcagtaaccgcatcggtgtcctttcaatatgtggcatattgtggcgtttaggtgcagtttcaacacttttctgaggcaacatcacctctaattgtgttggatcaagaatacctagtttttgccccaatatatttcgtaaatacaaacgtagcatttcacctgggatacgcttgatcaaaggcaatgctaatgaagcgagcttagattttccctctttagtagaaagatcgacctgcgtaagcaaagaatcaaataaaaattcactcaatgtcaatgcttgttccaaatagcgttcaaaaccctctttaccctgagagcgaataaaggtatcaggatcttccccatcgggtaagaaaataaatttcagttgtctgccatcgtgtaaataagacaacgcattttctaatgctcgccacgcagcatctcgccctgcacggtcgccgtcgtagcaacagatcacttgctctgttgatctgaacattaactgaatttgttcacctgttgtcgccgttcccaaagaggcaacagcattattcaccccaaattgagctaaagccactacgtccatatagccctcaacgacaaataaaaagtcagggttttcattatgttgtaaggcttgatacaaaccataaagctcattgcctttatgataagtggcagattcaggggaattaagatatttgggtttttcgtcgcctaatacacgcccaccaaaagcaatcactcgaccacgcttatctcgaattggaaacatcacacgattacggaaacgatcatacacattgccacgatcatttttagagagcatacccgtatcaagcaacttttgaacttcttcaggattatttccaaagcgacgaagcactgcgtccatcgcattcggagaaaaaccgatttcaaagcgatcaataatctcttgagataaacctcgttgctgcaaataggcttgactagcactatcttgcgttaattgctgttgatagaacttagcgaccaaatctaacaattcataaagattacgccgagttttataactggcttgtggtttgccatctctattgatcacattttcacgaggcacttctaacccgtgcaatgcagcaagttcctcaattgcttcaggaaactctaacttgtcatattccattaaaaagctaatcacattaccgtgtacgccacaaccaaaacagtgataaaactgtttagattggctcactgtaaaagagggacttttttcgtgatgaaaaggacaacaggcttggtaatctcgccctgcttttttgagtttaacacgactattgatcagctcgacaatatcggttcgagcaacaagatcatcaataaatgaacgaggaatagagcctttcattgattatctccttgctagcaagtgggtagtttcgcaaacttttttacaatgctcaccgcttgtaatggacggtataaacattgaaaccgtgattccttaaaggtttcacggttccaatttaacttctgttacctaatttaaaattagtataaacgagtgttacgcgcgttctcacggaagttacgtttagcgtgacgttttgctaaagacgctttttcacgtttacgaattgtagttggtttttcatagaactcacgagcacgaacttcagctaaaagacctgctttttcgcaagagcgtttaaaacgacgtaatgctacgtcaaatgattcattttcacgaactttaattactggcataagccatcacctcaggaaatatatgtttaaatgaagccgcacaaattggtggcggcatagaactaaaaaaggtgaggcattttagcttagactaactaataagtaaagagcaccttgtcaaaataatctacaaacatacagcttttccaaaataactttactttggtattcactgaacaataatcttggaaccattagaaaatacgatgcttcttgcctcataaattgcatttaatgcaatattatttctaaaactatcctgtatattctgaggcaaagtatccaatgaaatagaaaaccattttcctatatatttacaatcttactccatcaccaactggtaacttggttttagaaaacatgtataaaaacgaagtatstatctataaattcttaaaaatacttcaatacttttattcttgtaaagaaaaaataccgattttctaataatctcaaaaaccggtatttacataaattactcctcaatatctaaatatcaatcttattgaattttgtttatagagaagtatatttcatttcaattatacgaaatggacaaatattatttagtatctatgactggtgttgcttcttcagtctgagaagacactgcgtcctttatcccatccactttagtttcaactaattgtnnnnnnnnnnnnnnnnnnnnnnnnnnnnnnnnnnnnnnnnnnnnnnnnttagtttcaactaattgtttagtttcttctactttagtttctgttgtttgttttacctcagcaactttctcttttgcttgatcacaagcggttaaagaaagtgttgctgcacctaaaactaaagcggccaataaagattttttcataaaaataattcctataaattaaggtttaaattgccacatttagagtaaatacttaggaattagttccctaagcatttacaagtgattaaagatcaaccttttatttttgcacccctcggtgcagaataaacgtggctcactgcactactatgtccgccaaagccttttccgtagaaatagtattttgagttctgccactcttttgcttgaattaaggcaatttcttccgctggtgctgctgcaaccgtcatttctacttgcgtatgtgcaacacgagagaatgtgcctagtttcccttcaaactgatattgactttgataaaccttaatcggttctggaatcggagctgcaactttctgctcagattcgaccgcttgaggccctagctcttccaatttaatatggcgacgttcgtgattttctttaactaaatctcggttagtcggttgagaaaccacaagtccgaatggtttagccgataaagccactgctttcggatcaacttctgcggattctgcttcaactttcgtacgacgtttgtggttgtctttgactaaatcacgatctgaactttgagttacgaaataaccaaatggcaccgctgaatcttgatgagcctgagtgttagcttcctcttttacgggttcagctacttctcttgctacagattgaactggctgttcttgctgttgtaacatctcatcaacagataagaaacgaggtttctcttccgcaacagcttttggcatttcgctaaatttaatccaaaccttaccgcttgcaagttcaggcgaagcgacagccgaagttaatggcattactgcttttacttcctcacgacgctcacgacgacgctgattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcctacgcgtaaatggcgaggtaaacggcgttggcgaggctcacgttgctctgtacgctcttctactacaggctctgnnnnnnnnnnnnnnnnnnnnnnnnnnnnnnnnnnnnnnacaggctctgccacaaatgaatcagccgcattctcttctgctggtggtaaagaagcggtaatttccgctgaatgttctgcagtttcaattcgcactttcttacgtaagtcacgacgctggcgacgctcagccactttcgcttcacgctgttgcggaactgaaacacctgccacttcttctacaatttcacgacgtttcttaggctctactggaacgacttcagcttctttcgttgcttcaacgaccgtgtttttacgctcttggcgttcgttgcggtttggtttttcacggcgttgctgacggcgttcacgctggttacgagccttacctttaccttgcttcttctcaggttctttctcttcgcttgcaaacattgctttgattttcgcaataattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctggctcaactggtgttggtgcaggctgtaaatttaactctgaactttgtaatactgattcaacggtaatcactggcttattacggctaaccaacgcttcttccgaatggtgatgatgaatgtgattttcttcatcttgttcttggtagcgtttcactaaatcgtaacttaaggttggaacgatctcattctcacgcaggcgatatacgctaaagtgtggggtttccatactttcggttggtacaacaatcacttggacatcgtggcgtttttcaatgtcgctaatcgccttacgtttttcatttaataagtacgaagcaatttccacaggcacaatagcgtgaacctgtactgagttttctttaatcgcttcttcttctaataaacgtaaaatggagagtgcaatcgactcgttatcacgaatttttcctgtaccttgacagcgagggcaaacgtgtgatgacgcttcacttaatgatggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcttctaagttggtatttaatgctgtttcttcaatgtctccaccacgggtcgcacgagatgagttgatgtcgatagctgtcaatgcttcggttacatcaatcacaatagaaccgcctgacggcaaacgcacttcacgttggaatgctgattcgatttgggattcgatttgatagtgactgaacaacggtacttcaccttcatacaggcgaacacggttgataaaatcaggacgcacaaggcggatatgattttttgctttctcaaataccttacgattatcgatcaaaatctcaccaatatcacgacgaagataatcacggattgcacgcacaatcacatcactttcttgatgaattaagaacggtgcagggcgagattctgccgcttttttgattgcctcccagtgatgtaataaaacttttaagtcccattgtagctcttcaggggatttacccaccccagcagtacgcacaattaaacccacatcttcaggtacatctaagcaatctaacgcttctttcagctctaaacgctcgtccccttcaatacgacgagaaataccgccagcacgagggttatttggcattaaaacaagatagctaccagccaaagagataaaggtcgttaaagccgcccctttattaccacgctcttccttgctgacttgaacaataacttccgccccttcttgaataatatcttttatgtttgggcgaccttggaatacataaccttgagggaagtattcacgagaaatctcttttaacggaaggaaaccgtgacgctctgcaccgtaatcaacgaatgctgcttcaagactgggttcaacacgggtaattttacctttgtagatattcgctttcttttgttcgtgtcctgggctttcaatatccaagtcgaacagtcgttgcccatcaacaagggcaacacgcaactcttctttttgagttgcattgattaacattcttttcattgtgttttctcattttatttttgttagtgctattcatagggttcgggtttgtatttttgctaatctgtcaatctcccgactgtctaaggacaaactgacgtgaaccctatgatctaaggtgatctgttttatgtcttacactcaaaatctgaccgcataatcaatcacgatatttgcatttttaaccgttgcaagcggtacttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtacttttgtctgattttctacaattttattcagtaaaattcaatagacagaaaaagcgagtcattatggcattttaagagaaaaatagaaaggcaaaagtaaataacgtaccataaataacattgaatgtattttatacaatgtttgcggctgctaacgaaaaaggtagtctctctaataacttctgatgaatctgaccaaatgccccattactcatcactaaaatatgatccgttggtttagcttccttgacaatcaattccactaattcatctaggcttgccgaccattgtgccggctggcttagtgcatctgtaatcgtgctgacttgccacggaatggtatcgggttgataaacaaagacggcatcagcgtctttcaacgatggggcaatttcctctttgtgaacgcccattttcattgtgtttgaacgaggctctaataccgctaaaatgcgttgttctttacctactttgccacgaagtgcgtcgatggttgctaaaatagcggttgggtggtgagcaaaatcatcataaacggtaacgccgtttacttcccctttgacttctaaacggcggttggcattgataaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtttaaacctaaacaggcttgctcaacgcttacccccgcgtgatgtgctgcggcaatcgccattaagccgttgtgcatattgtgagcgccgagcaagttccattccacttcccctgctttttgctgtttatggtaaatcgcaaaatgggagtaatccgaacttaacggctcggcgtaccaatcttgatcttgcccgataaattgttgttcgctataacagcccatttttaaggtgttttggacattttcatctgatgttgcagacaaaatgcagccattttgtggcattgtgcggataagatgatggaactggcgttgaattgcttttaaatcatcaaaaatatctgcgtggtcaaaatcaatgttgttgataattaaggtttttggattgtaatgtacgaatttagaacgtttgtcaaaaaaggctgaatcatattcgtccgcttcaatcacaaagaaatcgcttgagcctgcacgagcagaaataccaaagttgcctgcaacaccgccgattaagaaacctgtatcaatgccagcttgatctaaaatccagcttaacattcccgttgtggtggttttgccgtgcgtgcctgacacagcaagcacccaacgatctttgagtaaatgatctcttagccattgtgaccctgaagtgtatggcaagcggtgatttaagatatgttctacgcaagaattaccacggctaatcgcattgccgataataatcatatcgggaacaggatcgagctgtgcaatatcgtaatgggggataatttcaatgccacttttttccaaaaaggtactcattggtggataaacattggtatctgaccctgtgactttataacctaactctcttgcaataatcgccacgccacccataaaggttccgcagatccctaaaatatgaatatgttgctgtttcatagcattccttacataaaaattgtgaacagtatcacaaaacaaaactttactcgaaaacagggtttcaatgggcgagtataataaagcaaactgtattgaatagctaataaggagataaaaaatgaaaacattaggcgaatttattgttgaacgccaagcagaatatccaggagctacgggggaactcagtggtattctatcttccattcgtttgtctgcaaaaatcattcaccgtgacattaaccgagcaggtttaacccaagatattttaggtgtatctggcgatgaaaacattcagggcgaaacccagatgaagctcgatgtatttgccaacgaaacaatgaaaaaagcattaattgctcgtggcgatgtggcaggatttgcatctgaagaagatgatactttcgtggcgtttgatacagaacgtggtagaaatgcaaaatacattctaatgacagatccccttgatggttcgtccaacattgatgtgaatgtgtctgtcggaacaatcttttcgatctacaaacgtgtatcaccgattggcacgcctgtgacgatggacgattttttacaacctgggcgtaaacaagttgcggcaggctatgtgacctatggttcatcaacaatgttagtttatacgacgggtaatggcgtaaacggctttacctatgatccttctttaggtttgttcattctttctcacccaaatatgaaaatgccgtttgaaggcaaatattattcgattaacgaagggcaatatctcaaattcccagagggcgtgaagaaattcattaaattctgccaagaagaagataaagcaagggggcgcccatactcttctcgttatatcggctcattggtttcagacttccaccgtaacttgttaaaaggcggtatctacatttacccaagcacgaaaaaccacccgaacggtaaattacgcctactttacgaaggcaacccgatggcattcttagctgaacaggctggcggtatggcgactgacgggtttaatccgattttagacattaaaccaactgaattacatcaacgtgtgccattctttgtgggttcaacagcaatggtacaaaaagcgggcgagttaatggctgaatttcgctagtaaataatggaaagaaactcaccgcttgtttacgcaagcggtgagttttttatatcattttgttataaagaccacatttttgttctttaccttcagcaaaataatcggtatcttgcttgcaatttttcactctttattggagatattatgaaactaaacactaaattctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaacactaaattctctctcttagccacgacattattggtttcaactgttgctcaagcagcagataaaacgtttattaactgtgttagccgttcaccaacaggttttagccctgcattagtgatggacggtatttcttataatgcaagttcacaacaagtctataaccgtcttgttgagtttaaacgtggttcaacagatattgaaccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggacagtgagtgatgatggtttaacttatacctttaatttgcgtaaaggtgtgaaattccactcaaataaagagtttaccccaagccgtgattttaatgcggacgatgtggtgttttcattccaacgtcagttagatccaaatcacccatatcacaatgtatctaaagcaacttatccgtatttcaaagcaatgaaattcccaacattgttgaaatcagtggaaaaagttgatgatcatacagtgaaaattaccttaaaccgtcaagatgcaacattcttagcgagtttaggtatggactttatctcgatttattcagcggaatatgcggataaaatgttagcggcaggcaaaccagaaaccattgatacaacacctattggtactggtccgtttgtgtttgcaggctatcaagtggatcaaaaaagtcgctatttcgcacataaagagtattggaaagggaaagctgatattgaccgcttgatctttgaaattgtccctgatgcaacggctcgttatgcaaaattacaagcgggtgcttgtgacttaattgacttcccaaatgctgcagatcttgagaagatgaaaaccgatccgaaagtgaatttactttctcaatcagggttgaatattgcttatattgcgttcaatactgaaaaagcaccgttcgataatgtgaaagtacgccaagcgttaaactatgcggtggataaaaatgcgatcattgatgccgtttatcgtggtgcaggtgtggcggcgaaaaacccacttccaccaacaatttggggctataacaacgaaatcactggttatgaatataacccagaaaaagcaaaacagttattaaaagaagctggctttgaaaatggttttgaaacggatatttgggtacagcctgtggtgcgtgcttctaacccgaacccacgtcgtatggcggaattagtgcaaagcgactgggaaaaagtgggcgtgaaatcaaaactggttagctatgagtggggcgactacatcaagcgtactaaagcaggtgaattaacagctggtacttacggttggtcgggagataatggtgatccggataacttcttatcgccattattcggtagtgaaaacgtgggtaacagtaactacgctcgcttcaaaaatcctgaattagatgcgttattacacaaagcggttggtttatctgacaaggcagagcgtgccaaaatttatgaacaagcacaggtattgttaaaagaacaagccccttggatcaacgtagcacactcaattaactttgccccaacaagtaaacgtgttcaagactataaacaaagcccatttggttatacttacttatatggtacgaagttggcggattaatctgtcttaacaggaaagggaagcaataagcttcctttttcatttcattaccgatgagaagataaatcagctataattcttcccaaaaataaagaaataaaatacacatcttaaataagggagaatatatggaaattaaatcgtcacggaaacgcttaaccctcaatgatattgcacaacttgcgggtgtatcaaaaaccacagcaagtatgatcttaaatgggcaggcagaacaatttcgcattaagcctgaaacccgccaaaaagttgaagaaatcgcaaaacagcacggttatcgtgcaaatgcttatgcaaaagcacttaaactacgtcgcaccaatgttattggtctggtcattcctgatttaaccaattatggctttgcctctacagcaaagactttagagaaattgtgccgagagaatggtttgtacttagtcattgcttgttctgatgataatcctcaacaggagaaacaagcgatagatcgtttacttgaccgtcaaattgatctcttaattaccgctccaacacatcaagatccaaaatactataaatccgtattaaagcacactcttctattacaacttgaccgctatgttcctcaacttgaattaggttatgtgattagtgctgataccgaaaaaattgcagaactagtatctctaacgatccaacgctatcaacttaaagaatatttttattttggcggtcaatgctcactttctcctagtgaatctcgtttagctggttttcgccaaggcttaaagcaaggtaacttacaagaagaaagcggttggattttacataaaaattaccaacctgaatcaggttatcagttgatggcagagctggttgaacgtttagggcgtttgcctgaagcagtatttaccgcgtcttataccattttggaaggtgttctacgttacctcactgaacacaagcaaatggataaactgttgaacggtcaattacatttagccacttttgatgatcacgatttacttaacgctctgccgtttcatattcattcgattaaacagaatcatcaacaaattgcattttcgctgtttaacggagcagttaaaagtagaatgtgaaattatttggagaagataagatgattacaagtatagcctagatttttctccctacaataatagttaatccattcttgtcttactatattgtaaacaaaaatttccaaaattcttttttcggagtatcataagcggacagatcaaaggcttattttacaaaaggaagagaagatgcgatttgcgattgagtgtattgaacgtgtgggcgttgctcaagatattttaagtttattggcaacgcaaggcataaatttagaagggatcgaactgcaaaaattaggcgaaaaagggcttgtttatttgcgtactgaagcaatggagactagccagcaagctaattttgtcaaacagttgaagaaaattccaagtattactgctgttcaagaaattcatcatcttccacaagaacgtaaaaatcttgagttgagagccttaattgaggcgttgcctaatcctgttttatcgcttgatctcaacggtaaaattgcctttgctaattctcaagcctgtaaagttttattaccgatttatcgccagtcgctacctaagaaaaaacaagagcaaattctttctcttgaaggcgttgatctcaacgaaattatcgtcaatctcaatcgcaccaaatggtatcagtgggttttgcaacaaggtcgttctattttaccgacaacgttacagccaatttctcaccctattcaatttaatgatcaagtatggcgaatggatttactgccgattgaattgtgggaggcggcacaaaaccgaccgcttgggtatgttgttactctgcaatctcagcaaacaatgcaactcgatttacgtcaatttatggcaaatcaaaacagtgatttcgatcatattttgacgaagagtgccaaaatgaaagcggtgattgaacaagccaagaaatttgcgatactcaatgtgcctttgcttattcaaggcgaaacgggaacaggtaaagatttgtttgccaaagcgtgccaccaatttagttttcgtcgggatcaaaaattcattgccgttaattgtgctggattgcctgaagaagaggctgagagcgaaatgtttggacatcacggtggcgaccgtacacacgttggcttttttgagtatgccaatggcggaacagtattgctcgactcggttgcagaactatcccttgaaatgcaaggcaaattattacgttttttgaatgatggatcatttcgccgcgtaggtgaagataaagaaattcaagttgatgtgcgtgttatttgtacatcacaaaaaccgcttgcgaccttagttgaggaaggaaaagtacgcgaagatttatatcatcgcctgaatgtgcttaccttaaatttaccgccgttgcgtgaaagacaaggggatttaatgctactgaccgatcactttattacccaaatcagtcagcaattaggcattcgtaaaccgctttacgatgaacattttatcaaagccctacaagcttatcattggtctggaaatttacgcgaactttataatgccatttatcgagcttgctctttagctaccgatcaacttaaagcgagtgatcttaacttgcctgaaacggtgccaagccattttgaaatctcacatttagagcaaggttcattagaagagctggttaatcgttttgaagcctcactgctacgcaagttctatgcggaatatccaagtacgcgtaaattggctcaacgcttaggggtttcacatactgccattgccaataaattgcggagttatgggattagcaaatgatgaaacaacttatgctatggggatttgcatttttaggtgcatatcccaccgcttacgcttcgcctaaaattccacaagcgttgctaacaaacagtctggtttactgtaccagtgcttctggtttttcttttaatcctcaaaaagccgatgttggctcaaatatgaatatcgttacagaacagatttacgacaaactgattgaatttgatcctgaacaaaaccagctgaaaccagcccttgcagaacgctttgaaatcagtgaagacggtttaaccattacgctatatttacgcaaaaaagtctcttttcatcatacaaaatggtttacgccgacacgctatttgacaagcgaagatgtgatcttttccttaaatcgaattttgggcaaagttgatgaactgcctgagcttaatcgagaagtgcaacatcaagttcgtcaccgaattgcagaccgcacccatttctcttattttgaaagtgtcgatctcgctaatcagatcgtcgagatttcagcaccttcatcgcatattgtcaaaattcgtttggcacagccggatagctcaatcttggctcatcttgccagtcagtatgcggtgattttatcgaaagagtatgccttacaactcaatgccgatgataatttaatgcaactcgatattctgcctgttggcacgggggtatatcagcttgataattatgtacaaaacgattttgttcgcttacagcctaatcctcgctattggggcaaaaaagccaatatcagtaatttagtggtggatttctctacctctggcacagggagaatggcaaagtttttgaacaacgagtgcgatatttctgcctttccagaaccaagtcagctctctattttggataaaacgcaaggctatgtaattgaaacggctggggcaaaccttgcctttttagcctttaatttccgccaagataaaatgaaagatcctgctttacgccagaaaattgcgacaagtattgatcgtgagcgtctagcgcgtattctgttctacggtgttgctgaagtgccacagaatgtactaccgaaagcgttgtatgctcaagcaaatccaacaagttatccctattatccgcctgatacgagtaaaaaagtggaggaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgccaagtgagccgagcctacttaactcagcaacttgaaaatcatcaggcagattatgatttaattctaagtggttggttagccaataattttgatcctgatagttttctctcttcgattttaagttgtcgcttgcaagatgcggtgaccaatctatctaattggtgtagcgtggaatttgatgaattgcttaaattagcaagaaccgctgaagatccacaaagccgaatgcaatattatcaacaacttcaaactctacttgaagaacgcttaccgctgttacctttggtgaatgtcaaacggttgttagttgccaataacagcgttaagaatgtcaaaatcagtgcgtttgggcaggttaaattatctgacattaaggtgaaataaaatgttgttcgttcttattcgtaagctcttgttaatcatcatttcactgatgattttatcgcttatcagttattttattttgctgagaaatccgcattattctgtcattgaacaaggcttctcaggctatgcaatttatttgcaacaattgcttgaagggaatttaggcgttagcgaaatgacaggtgagcctttaacgaaattaattttaaatgtctttccagccacgatctcgctctgtttatcggctatgttactttcgctgatgctaggcattccgcttggcttttttgcggcgctacaacggcaaaatatgattggcaaactgttaggctcactggggtcattaagccttgctgtgcctgtattttggcttgccattgtcttattggcgtatgcttctagccatcattgggcaatttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatcattgggcaatttcagctgtcggcgaactccaccccatttatgcggtgccaacaatcacaggcgttaaaattttagatatttttctttcagatgcaccacataaattaaaaatgatgcaaagcgccttgcatcatcttgcactgcctacccttgtattagctgtgccagcgacgttagaaattatccgaatgacaaaacaacgtacggaatatgtgctgaaacaaaattatgtcaaagtcgctcgtacacgaggctggtcgccacttaaaatctggtgggtgcatattttacgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttccgcaggcgtgcttgcgattggtatttttgttctcagtgtggatttactggcaagcctattaactaccctacttgacccatcgcagaaaaaagattggtatgccaaggtataagaaacaatggggacttttaggggtgctatatctcgtgctgttaaacattttttactctgctaatacgctttgttttctgcatttaatttagaaaataaagtttgttgtgtctcattgtatctactcattcttccgtgcatttgctatacttttatccctttaacttatttattcatcggatactgcaatgcaattaaaatcctacccagcgccaacctacgcacaacgtgccaaaatcgcgtttcaatatatgatgccacagctgtacttaacccaagcagcaggctggcttgcggaacgtaaatggggagtaatcactcatttcatcatcaatgtttttgcgaaaaaataccaagtcaatttagcagaagcagaaaaaactaaggcttctgattatgtatcatttaatgaattttttattcgtccattaaaggaaaatgctcgcccaattaaccaaaatccacaagcactttgtttacctgcagacggtcgagtgagtgagttgggtaaaattgaagagaaccaattattacaagcgaaaggtcaccaatttagtttagaaacattacttgctaatgatcttaatctggcagataagttcaaaaacggcaattttattaccacttatttatcgcctagagattatcaccgtgtgcatatgccgtgcgatgccaccttgcgtaaaatgatctatgtgcctggtgagctgttttcggttaatccatttttagcagaacacgttccaaatctttttgcgcgtaatgaacgtctgatttgtgaatttgaaacggcatttgggcctatggtgcaaatccttgtaggggcaactattaccgccagtatgagtactgtttgggcaggagttatcaatccgccaagagcaaaagaagtggcagtttacgaatatctccctacaggcgaaaccgcagtacatttgaaaaaagggcaagaaatgggggcattccgtttaggctctacggtgattaatttgttcccgaaaggtgctgtggagttggaagctcacttaaaagcaggcgaaccaaccaaaatgggtgaacgtttaggtaaaatcaatctctaaaagtggggcgttcatatacgccctttgttatgtgtaaggaaaacagatgaaagccaagttacttattccactgattgtttttttagggttaattattacctttactattcagcttcaacgcaatgccaatggagaagatccaaaagcacttgagtctgctctcgtaggtaaaacgatccctgaatttaagttagagtcgttacacgaagcaacacagatgttagattcatctgtggttaaaacaggaacgccacgcttattaaatgtatgggcaacttggtgtccaacttgttttgcggaacatcaatttttaactgttcttgctaaacaaggggttgaaattgttgggatagattataaagatgagcgtgctaaggccttaaaatttttaaaagattatggtgatccttacaaagccattgtttatgatccaaaaggctctttagggttagatttaggggtttatggtgcgcctgaaacctttattattgatggtaacggtaaaattcattaccgccacacaggagatgtgaatgaaaaagtgtggaatgaagtgctaaaaccaatgtatgagaaattgaagtaatgactatgaagaaattatttgcactcttattgcttgtctccgcattaagcatagcttcgacggatattcagcaatttgataatgcacagcaagaatctgattatcgtgcgttaatccaagagctacgttgtccccaatgtcaaaataacaatattgcagattcaaatgcaaccattgcgacagatatgcgtaacaaaacccttgagctattgaaacaaggtaaaagtaaagatgaagtcgttggctatatggtggaacgttatggtaatttcgttacctatgatcctcctatcacaccagcaactattctactctggcttatgccgttattgttaattggggtaggtttaggcattatgtttaaacgtaaaaagcgtgtacaagcggtcagtcctgagcaaaaaaatacaaatgtggtcgatacagctcgccttaatcagattttaaacgaaaaggataaatgatgaatttttggattttagtcacgattattacgctgatgattggcgtggtggcgttctaccctttattgaaacagcgtcaaaatttaagtgcacaaaagcgtgataacctgaataaggcattctattttgaccgtttaaaagaagtggaacaagaagcggcagcgggaattattgaagatagcgagcagacgaagctcgaacttcaacaaagcctgcttgatgatattcctgaacatcaagcacaagcggtaagttcggcgaaatcatttggacatcttggcaaattatggtttatcaccttgatcttattgattggcggtattagtgctgggatctattggaacatcggttcgtggtttagtggcacaatgcttgaaatgagccacaaaaagcttgattatttttatgaaagagtaaaaacggaagaaaccgatcccctttcagaacaagagctgaaccaatttgcaatggcactacgtgttgagctacaaaaaaatccgaatgacgataaacattggtttatgctaggtcagttaggaatggcgttggataatggacagctagctcttgatagttttgctaaagcgagcaagctaaaaccagagaatatgcagtataagttacgtcacgctgaaattttattgttctctgaagacccaaaagataaatcgcaaggtgagttattgctcaaagaagtgattagggcagatcatacaaataccaatgccttgagcttattggctttccgtgcgtttgaacaggaagactataaaatggcggcaatgacgtggggaatgatgttgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggggaatgatgttgaagttaatgcctgaagatgatcctcgtcgccctacgattgagcgtagtattcaatctgcgttgtcgatgataaaaccaggagaaataaaagccccctaactcaccgcttgttattttatagactagatgtaatgcaaaaacctctcgcaatttttttaatggggccaacggcatcggggaaaaccgatcttgccattgccctacgccagcagattcctgttgaggtaatcagtgttgattccgccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcagtgttgattccgccttgatttataaaggtatggatataggcacggctaagccgagtaaggctgaactcgaacttaccccccatcgtttaattgatattcttgacccatcagaaagttattctgttatgaattttcgtgaagatgcgttacgagaaatggcagatattacggctcaaggtaaaatccccttgttggtggggggtacaatgctttattacaaagcattgcttgatggcttgtcgccattgccttcggcagatccagatattcgggcagaaattgaagcaaaagcagagcaaatcggttgggcaggtttacatcaagaactggttaatatcgacccgatttcggctaagcggatcaaccctaatgatagccagcgtattaatcgggcgttagaggtcttttatatttcgggaaaaacaatgacggaactcaccgctcaacaaggcgaaggtattccttatgagataatgcagtttgcgatagctccccaagagcgagctgtgctacatcaacggattgaacaacgttttcataaaatgatcgatttaggctttgaacaagaagttcgacagctttatcaacggggcgatttaaatgttgatctgccttctattcgctgtgtcggttatcgacaaatgtgggaatatttggaaggtcaaacttctcttgatgaagcaatctttaagggaatttgtgcaactcgtcagcttgctaaacgccaaatcacttggctaagaggttggacgagtgagctagaatggcttgatagtttagatcctgaaaattcttataaaaaaatgatcgaaaaagtacagcaaaagcatttgaaactgtggtaatatcgcaatgcctttggcaaagcattaaacaacaataattagaaggaacataaaatggcaaaaggtcaatctttacaagatccatacttaaatgcacttcgccgtgaacggattccagtttccatttacctcgtgaatggcattaaattacaaggtcaaattgagtctttcgatcaattcgttattttattaaaaaacacagtgagtcaaatggtttacaagcacgcaatttcaaccgttgtgccagctcgtgcgatttctcacaacaataactctaaccacgctcatcaagccgcaccagtgcaatctgctgaagtggtagagaaagtggaataattttattactacgttagacctcttgaatgaaccaaacacagcaaattctgtgtttggttttccgttgcctgaaaaaacacaaaacacgcctgacaaagagcgtgctattgtggtacatctttacctctctcaaactaaagatgtagaaaatctgatggaatttcaaactcttgccgagtccgcaggggtagaggttgtcgctacattgacaaccacacgttccgcaccccatatcaaatactatgttggtcaaggtaaagcccaagaaattgcggatgcaatcaaagattttgatgcgaccgtcgttttaattaatcaccaacttagccctgctcaaacacgtaatctacaatccctttgcgattgccgagtggtggatcgtacaggcttgattttggatatttttgcccaaagagcaagatctcacgaaggtaagttacaagtcgagctggcacagcttcgccatttatccactcgcttagtccgccgtttaggtaaccaagatcaacaaaaaggcggtgcggtaggcttacgaggcccaggggaaacccagttagaaacagatcgccgtttaattaaagtgcgtattcagcagttacaaaaccgcttggaaaaggtaagtaaacagcgtgatcagaaccgcaaaactcgtcaaaaagcagacattccaaccatttcccttgtgggttataccaatgcaggtaaatcaaccctatttaatgcgattactgatgcaggtgtttatgcggcagatcaactgtttgctacccttgatccgacattaagacgaattcaaattcaagatgttggcacagcgattttggcagatactgttggctttattcgctttttgcctcacgatttagtttctgcgtttaaatccaccctacaagaaaccacagatgcgacattgttgctacacgttattgatggtgcagacgaccgtaaaaatgaaaatattgatgcagttaatcaagtgttagatgagattgaagcattagaaattccgaccttgctcgtgtataacaaggtggatcgcttggacagcattgagccacatatcgaatacaacgatgacggcaaacctgtggcggtttatctttcggcacaacaaaatcaaggcattgatctgctatttgaagcaatgcgagtcagacttaaaaacgagctggtctgtgaaagagtactgctacccacaacaagcggtcagatttacactaaattttaccaacagcaatgtatcaaatcagagcgtttcaccgaatttggcgatcgtttagtggaaattgaagtcgataaaattcaatggcaaaagtggcttaaacaataccctgaactaacggaatttgttgagtttgcgaaatgggaagcagagagttaatattgacctaaaaacaaaatatcgagcgtatctcaccgcttggttaaggaaataagatgacgaaacaattcaaattaatcggttttgacctagatggaacgctagtcaatagcctgcccgatttagccttatcgcttaactctgccttcgccgaagttggcttgccacaagcctctgaagagcttgttctgacttggatcggcaatggggctgatgtgctttttgcgaaaggaatggaatggacaggaaaagcagacgaattttcacaggacgaattagcccaaattaaacgccgatttggttatttttatggcgaaaatgtctgcaacatcagcaagctctatcctaatgtcaaagacaccttagaagcactcaaagcacagggttatattttagcagtagtaacaaacaaaccaactaagcacgttttgcctgtattgcaagcctttaaaatcgatcatctcttttctgaggctcttggtggacaatctctgcctcaaataaaaccacacccagccccactttattacctttgtggcaaatttggtttatatccccacgaaatgttatttgtcggcgattctaaaaacgatattctggcagcgaaagcggctggttgtaaaagcgtaggtttaacctatggctataactacaacattcccattagtgaatctgagcctgattatgtttgtgaggattttgctgagattttgaacgtcatacaccagtaactagtaaggtagcatttgaataataggcatagtaggcaaatttattacccatctatcaaaaattattggcatagtagacaagagtgttgttttttgcaaactatgcctctaatggacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaagccactttttaccaacgcttttgtctactatgcctaatcatatctaatgatatcagcggtaaaacatttaataatgtaataatcattatatctgtttttgattttcagcccaccaagctgcacctatcaatccagcatcttgggcataataagcaggaacaacatcagggcgataaatttcaggcatttcggaaaggaaatgggttactctggctaaataaccttctgctaatccaacacttccgccaagagcaattcgttgaatatctaagttaattttgagatcggcaattaagtgagcaatcgcttttgcagatttatccactaaagcagccgcttgtggatcgcctgctctaaagcgtgcaaatacttcaggcggttcgcacgggttatcccatttagctgcatcacgagcaatcgcacgccctgcagcaacggcttcgacacagccgacacgtccacagccacacacttccccatttggatcagcaaggctatgtccgatatgtccagctacgccgtttgtgccagtaaagagtttgcgatttaagataataccgccccctacacctgtcgaaacggtaataaaggcaaaattttcaatgtcatcttgacgtaaaaattcagcacaacccgccgcttgggcatcatttaacagtgtaatcggcttgtccgtgtgtttggcaacgctttgctcaagaggaaagaatgccagattgcctaaatttttcgggttaagtgcggttagaatacccttttgaataattcccgttgaagccaccgaaacctgatcaaatttccctttgaactgcgttaaaatttgtgccaaagcgctgtctagagcttctgcacttggattttgtggtgtgtgaatttgtgtacgttccgccacaatcgcatcttttccctttaaggtaacaagagcagcagcgatttttgttccacccacatcaatggctaaacaagcggtcatattaggctcctgttttgcgattatcaatggcggtcacaaaccagcttacgatatgctcaagacgagttaaagctgagccaacggttacagcataagccccattttcaatcgcaacggcagcaagttcaggggtattgtaacgcccttcagccattacacgacaaccactggcgactaaatcacgcaccagttgtacatctggttcatcaggggtttcaccgcctgtatagcctgacattgtgctaccgattaaatctacgcctaactcttggcagtacataccttctttgtagtttgagcagtccgccattgacattgcccctaactcttggatacgtcttgcacaggctttaatcgtggttggacgaacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgtggttggacgaacacgatctgtaccatcaaaggcaataatatctgcccctgcgtgatacaaatcgtcaatatcttgtaagaatggcgtgatacgaacagggctgtcaggtaaatcacgttttacgatacctacaatcggcacatcaacgactttacgcaccgcttttaaattatcaatgccttcaatacgaagccctgccgctccgccaatgactgatgcttttgccattgccgctacaatctctggcgagtccatcggaccgtcatcaacaggttggcaagaagcaattaaaccattttttaattgttctaaaatttgttgtttggttaatctcgacataaaaactccattagcattaaacaaaaagaaaatttactccaaagcatacccctacaaatgaagtaatgcaatcaatagcattaaaaagtgagagatagatcaaatttttctacaaataaaaaacaaaacggtgaatttattacaaattcaccgttcaagataagtcgttataaaacgagttttaatcgattatttaaaaaattcaacagctaaacgagcaccgactttcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaccgactttcgcattatttttcaccagcttgatattcgcttctaagctcttgccttcggtcatttcaacgattttaccgagtaagaatggcgtaatatctttacctataatgcctttttcttcggcttcttttactgcggtatcaataataccgttgatataacttggtgctaattcatcttcttgtggaattgggtttgcaacgaccacgccaccttctaagcctagctgccatttcactttgatcatttcagcaatttcagttaattcttcacacgataacgccaatggtaaaccgctatcacgagtaaagaatgctggtagatttttggttttataaccaacgacaggcacacctttggtttctaaatattctaaggttgcatcaaggtcaaggatagatttcgcccctgcacaaataacggttacgcttgtttgtgctaattcatcaaggtcagcagaaatgtctaatgtggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccagcctttatgtacgccacctaatcctcctgttacgaagaatttaatacctgcaaggtgagcacaaatcattgtagaagcaaccgttgttgcccctaattttttagacgcaataatctgtggtaaatcacggcgagaaacttttgcgatccctttgctgctaccaaataactctaattcatcatcagaaagaccaatacggattttgccgtcaatgattgcaatcgtcgcaggtacagcaccgttatcacggataatttgctcaacttcccttgccattgcaacattttgtggatatggcataccgtgagaaataatggtcgattctaaggcaacaatcggcaagtcttgagccataccacgttgcacttcatcagataaaataaggtagttattcataataatgctccatttcggtttctaattgagatttggttaaatttggtcgaacagtaaattccgactgaattgtatgataggcgttggttaaaccagctaagatcgctttgtcttgctcataattattaagccaagcataaataaatgctccactaaaagagtcgcctgcacctgtgacatcaatcactttgtggctatccatttttttaacggaataccaacgggtttcatcctgagatgcactcaaaatagctttagaacctgcggttaatacaatttgttttacgccttttgctaacaatattttagcggcttcttcaattttttgatcggtatctaatagcatatctaaataggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcaagttcccctttattgatgattaagcaacttacaccttgtaaatcttgaggaagacgatccattttcggttcggaaacggcaatcaacaccaaaggaatgtgataaccttcggcacttttgcaaaggtattcaatggtcgcttttgggcaattcagatcagccacaatacaacgagcatttttaattaatgcagtgtgtttattcagggcttcaggggttaagctgtcataaatcgacatatccgctaagcctagatacatttcgccttctttgtctagtaatgcggtataacagcctgtagattgtccttctacggcaatcacattattcatatccataaactcagacgagaaggatttaattctctcccattcaggatcgttgccaaccgtagaaataaagctcactttctgcccgagtctgcctaaattctcagccacattacgagcaacaccgccaatcgttgttgtggaatttactgggtttgacgtataacctcgaagttcttcgtccgttttaatttttttatcaacattcgccgcaccaatacataaaatagcgctacgctcattaagaacataagctctgcctaataaatattctttctttattagggcggaaatgatgttggcaatcgctgaacgagataatcccatatattcagcgagttcttgctgtgaaatgaaagggttttgacgtattaaatctaaaatcgttttttcattctgattcattgccgaactccattaggacaaatgttttaatgaaaggacacttgtcatattattaaattcattggacatagcgtcaatgtctttttcaaaaatttgtgaacaaactcacaaaaataaaggctgaatcccgttcagccttatagagtattgcaaaaaatttgaagaatcttaccgcttgtattattgaagtcgtttaatcgcatcaatcacgagatcccaaaaacgctctcgatctaaaacttttgccacataagtgttacattcttttggcggataacggaaatctgctaccgtcattccaagtgtatgtgttcctgttaattcaatattcacagggactttttgtgtttcgataagcgtcggatcaatcacataagctacagcacaaggatcgtgaacaggtggataatcaaacccttgggcctgtttatacattttgccgaagaagtctaacagctccaccacaaatttggctaaagcgtttcgagaaactttttccaaggtttgattgccaaccaccgttgttacagccaataaatcaatatctggattgccgtaagcaagcaaaatggcaatagcatcatcgtgtccaggatcgcaatccaaaataatttttttacgcatattatcttcctttagttcagtaaaaattaccgtgggtaaactacaataactctaactctataaggtgtaaaagaagctggcgtgaaaaaatgagagctacttcacatttttgataaataaagtccattttctgtcaatttattttttaactatgtaaaaagttaaagatcttagtttgaaaacttggtatattgtgcagcccatcatttttgatgagttagttgttataatcactataacatttatcatatatctcttctctttctttgaatggagtccttaaatgggtacgttaaatagtttattgggtatagttgttctactaggaatagcttttcttttgtcaaataacaaaagagcaattaacttccgcacagtttttggtgcattagcttcacaaatcggtattgccgcattaattctttacgttccagtgggtcgtaatgcattaggtgcaatggcagagggggttgctaaagtgattagctatggtaacgaaggcgttgctttcttatttggcggtcttgttagcgataaaatgtttgaagtctttggaggcggtggtttcgtcttcgcattcagaattcttcctatcattgtcttcttctctgcattaatttcattactttactatgttggaattatgcaatgggtcatcaaaatcattggtggtggcttacaaaaagtacttggtacatctcaagcggaatcaatgtcagcagctgcgaatattttcgcaggtcaatcagaagcaccattagtggttaaaccttacatcagcaaaatgactgagtcagaactttttgcagtaatgtgtggtggtttagcttctatcgcaggttctgtaatggcaggttacgcaggtatgggggttccacttacatacttgattgcggcatcatttatggctgcacctgcaggtcttttattcgctaaaattattcttccacaaacagaaaaattcaatgacagcattgagaacgttgaattagaaaaaccagcaaacgtattagatgcagctgctgctggtgcaagctcaggtatgcacttagcattaaacgtaggtgcaatgttaatttcgttcattgcattaattgcattaatcaatggtgttttaggcgctgtcggtggctggttcggttatgaaggtctaaacttaggtctaattcttggttggatatttaaaccattagcttgggcaatcggtgttccttggaatgaagctgaagtcgctggtcaaatgatcggtcttaaattagcgatcaatgagttcgtgggttacttagaatttgctaaatacttaggccccgaagctccaatggcattaacagacaaaactaaagctatcgttactttcgcactttgtggttttgcaaactttagctctatcgcaatcttaatcggtagtttaggttctatggcaccaaatcgtcgtggtgatgtagctcgcttaggtatcaaagcggtaattgcaggttctcttgcaaacttaatgagtgctgcgattgcaggtctatttatcggaattggtggtgcggtttaacactctcaattcttgaacgaaacaccacaggaaactgtggtgttgtcgtttatggcaaagttaaacgattgctttaagtaaggaataaagaatgagtttaaaatctattgcaaaacaagccttatctttaatggatttaaccacattaaatgataatgacaccgatgaaaaagtggtaacattatgccaacaagggaatacgccatttggtacgcctgcggcggtgtgtgtttatccacgttttgtgcctattgcacgcaaaaccttaaaagcacaaggtacagaacaagttaaaattgcgactgtcaccaatttccctcacggtaacgatgatattgacattgcagtggcagaaaccaaagctgcggtggcttatggtgctgatgaagtcgatgtggttttcccatatcgtgcattgatcgcaggtaatgaacaagtcggttttgagcttgtcaaacagtgtaaagcggcctgttctgccaataatgttgcattaaaagtgattattgaatcaggcgagctgaaaacagcggaattaattcgtaaagcgagtgagatttcaattaaagcaggggcagattttatcaaaacatcaacgggtaaagtgcctgtgaatgctacccttgaatctgctcatattatgctagaaaccattcgtgatttaggtgttgcagatagcgttggttttaaagccgctggcggtgtaaaaaccaccgaagaagcagagcagtacctcgcattaactgctgaaattttaggacaagattggattaaccaagctcatttccgctttggtgcatctagtttattagcgaatttacttgctacattaaacgatgaacaagtaaatcaaaatgtaacgggatattaatctctcaacaaacaacgaggaacagactatgactccacatattaatgcaccagcaggtgcatttgccgatgttgtattaatgccaggtgacccacttcgtgctaaatatatcgctgaaactttcttagaaaatgcagaacaagtcactaatgtccgtaatatgctcggttatactggaacttacaaaggtcgtcgtatttctgtaatgggacacggtatgggtattccatcttgctcaatctatgcgaaagaattaatcaccgaatacggtgtgaaaaaaattattcgtgtaggttcttgtggtgcagtacgccaagacgtgaaattacgcgaagtcattatcggtgttggtgcttgtactgactctaaagtaaaccgtatccgcttcaaagacaacgactttgcggcaattgctgactttgatcttactttagcggctgtacaagcagcaaaagcgaaaggcatcaatgtgcgtgtaggtaacctttactctgcagatcttttctacactccagatgtagaaatgtttgatgtaatggaaaaatacggtatcttaggtgttgagatggaagcggctggtatctacggcgttgctgcagaatttggtgcaaaagcattaaccatctgtactgtttcagaccatatccgtacgcacgaacaaactaccgcagaagagcgtcaattaaccttcaacgatatgattgaaattgcgttagagtctgtgttgattggtgatcagcaaggttaattaaaggcataccccctgattgattaatccgcatttttgtgaaatgaagtattacaagaatgcggattttatcataactgtgccgtaaagttctctccttcagagcggagatataagatataaacggtgtgggtcgtttcaaatctaattaatcaggtatttgttgttgcttgatgtattggtgaataatgaatgggggaaccaccgcggctgccagcaaatcgtgtttaatttcagtttcttcttttcatagatcaaatataaaatgtggaaaaatcacgctctaaactttgttaatgcaattacgcaaagactttaagttcgagataatgcccaacggcgagcaaatccgcataattaagcagttctgcagctatgctagggcatagtagacaaaatggctgctaatttcgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttaaggaatacaaacattagcaactatttcatccgcccatgtgttcaacatgagtaaaaagaatttaacagacaaagtatgtgattgatataagattcatttaaattcataacgaggaattgtttctagtctattcatctcatttatatgcacacggccccccactgttgcatgagcatcgtacttcctatttattgttactaattcaccattgtctttttttatagtaagtttaactgaatcaaaagatagatattcgctggttacaatagttgcattaccttcagatgtatatttttcagccgtacacgctactgatataatgcctattaataaaatactagataactttttcatataagccctttgtataaaataagccaattttaaagaagtgacacatttaaatcataagggtgcaacttaagacagcaaaaattctgataagttgcatttttgagtgaaattgccacacttggattaggtaaacgttcgccttcgacttgtggttggctgattttgatctttaattcgggattagcttgcaaagaaaattgctcatctatccgcttacaccactgctcaacgttctcgttttcgtacattgggataataatttcaatatgctcccagccttcttctggatagcttttacctttagggaacggcaactcaatcacggaaactgcctgtccgcaaaaatgcactggctgatttagagtaaacaaacctatcgggcgaccattaactccactctcttttaatagcgttgaaccagtcagtagcattgctttccattgtttagcaagctcattgctattcattcgtactgccagatgatctatctgatattggctcaaatcaatctgagcaatccctgcaatctgcgctatttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgctcaaactcagcaagatcaccaaaacaagcggtcaaatttgtgaaaaagtttgcaaattcggagcatttatcagtattttttagtatcattgcacacattttttagtattagaaataggtataaacgtgaatattcaacacattctatcggaaaaaatcaagcaagcaatgattgtcgcaggggcagagcaaaatgttgagccattagtgcgtcaatcaggcaaagtccaattcggtgattatcaagcgaacggcattatgggggcagcaaaaaaattaggcttaaacccgcgtgaatttgctcaaaaagtagtggataacgttgatttaaacggcattgcagaaaaattagaaatcgcaggcccaggttttatcaacattttcttagccccaacttggttagctcaacaaacagaaaacgcattcagtggcgataaattaggcattaacttaaatcaagctcaaactgtagtggtcgattattcatcaccaaacgttgctaaagagatgcacgttgggcatttacgttccaccattatcggcgacagtgtagtgcgtgctttagaatttttaggcaacaaagttattcgtgctaaccacgtcggcgactggggaacgcaatttggtatgctgattgcttacctagaaaaaatggaaaacgaacatgcgtctgaaatggaattgagcgatcttgaagccttttatcgcacagcaaaagagcattatgatagtgatgaagtctttgcggaaaaagctcgaaattatgtggtgaaattgcaaagtggcgacgattattgccgtacgatgtggaagaagttggtaaacatcacaatgcaacaaaaccaacataactacaaccgcttgaatgtgacgcttactgaaaacgatgtaatgggcgagagcctttacaacccaatgctgcctgaaattgtggcggatctaaaagctcaaggtttagccgttgaagatgatggggcgttagtggttttccttgacgaatttaaaaataaagacggcgacccaatgggcgtgatcgtgcagaaaaaagatggcggtttcctttacaccaccaccgatattgctgctgccaaataccgctttgagaccttaaaagcagatcgtgcgttagtcttttccgacactcgccaaagccaacatatgcaacaggcttggttaatcactcgtaaagcaggttatgtgccggacagcttcagccttgaacatcacaacttcggaatgatgttaggcaaagatggcaaaccattcaaaacccgtacaggtggcacggttaaattagcggatttacttgatgaagccgttgagcgtgcagaaaaattaattgcagaaaaaaatccagatttaaccgcttgcgaaaaacaagctgtagtggaagccgtggcaatcggggcggtgaagtactccgatctcagcaaaaaccgtaccacagactatgtatttgactgggataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataatatgttgagctttgaaggcaacaccgcaccttatatgcaatatgcctatacccgtgtgcgttcgatcttcagtcgtgcagggatcgacccgaacagcttaacggccaatatcgttttaatcgacgaaaaagaacgcaaccttgcgattaaattattgcagtttgaagaagccgtgacggtggttgccaaagacggcacaccgcacgttctctgccaatatctctatgaattagcaggtattttctctagcttctacgaagcctgcccgatacttaatgccgaagaaagtattaagcaaagtcgcttgaaactcgctcacttaacggcaaaaaccttaaaacaagggttggatctgttgggtattaagacggttgagaagatgtaaggcatagtccgtaaaaaacaacacttttgtctactatgccaacaaaaatatcggcatagtagacaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcccgtagcacgatatgcaccacagggtttagagtaaaaacctattatattgccatttatgttatttatgaacttattttttaaacgatattggtttaaaaaagtccagttaaacaaatatggtcaagatggcattctaccacattaaccaaatttagaaatcaaatacttatttatgctaaggaaaagataaagatagaaagtaatgaagtggtgctgataggcggacttgaaccgccgacctcacccttaccaagggtgcgctctaccaactgagctatatcagcgtttggagcgggcagcgggaatcgaacccgcatcattagcttggaaggctaaggtaatagccattatacgatgcccgctgttctaaattcgtctgtcccaaagaaattcaattaaagaaatggtggagggagaaggattcgaaccttcgaaggctgagccaacagatttacagtctgccccctttggccactcgggaatccctccacgataattgaatacttgataacgctagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgcgtcgtaagcaattaaggcgcattatagggatttcgaaaaaccttgcaagcatttttttcaaaaaaattaaaaaatccattctttcgcttgttaaatacgcaaattgctgattttttagatgtttttactaaatgttgtaagataaaatatctactttcattatttctattgtatatttcgggttattaaaaccgtaacaatatgaattatattcagcaaaaatagagaacttggcaatgggcatcactaaaattacgccttttttaacctttaatcgtcagcagtgggctgcattacgaaagtcagtgccgttaaaactgaccgaacaggatttaaaaccgcttttaggttttaatgaagagctttccctagaagaagttagtacaatttatcttccacttgctcgtttgatcaactattacattgatgaaaatctcaaacgccaagaagtgttacataaattcttagacgtagaatcgccgaaagttccctatattatcagcttaacaggcagtgtttctgtcggaaaaagcacttctgctcggatcttacaagccttactgtcagaatggcctgaaaaacgtaaagtagatttaattaccacagatggcttcctctatccattaaaaacgctacaagagcgaaatttaatgaagagaaaaggctttcctgagtcttatgatattcatcgccttattgaatttgtttctgatattaaatcgggcaaacgcaacgtcaaagcccccgtttattcacatctcacttacgacatcatccccgatcaatttaatgaagttgatcagcctgatattgtgattttagaggggctaaatatgttgcaaagtggtatgaactacccacatagcccacatagtgtctttgtttccgattttgttgatttctcaatttatgttgatgctgatgaaaccttattgaaagattggtatatccaccgtttcttaaaattccgtcgcagtgcattctctgatcctaattcttacttccatcactactcaaagttaagtgaacaggaagcaatcacaacagcttcaacaatttgggacgaaattaatggattaaatctacgcaaaaacattttgccaagtcgagagcgagcaaatttgattttagtaaaaggcgaagatcacgccattgaaaccgtcaaattaagaaaatagtaatgagtggctttcagttcaaacagtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttcaaacagtttttcattgcacacgactgctgtgcaatgaaagtcaatacagacggcattttactgggctcaattgcagatcctagcaatgcacgccacattctcgacttaggcacggggacagggcttattgcaataatgttagcccaacgtaccgctagtgcacaaattactgcacttgaactggaagaaaacgcgtttcaccaagctcaagaaaatgcccaacattgtccgtggaataacagaattgacgtactacaagcgaatataatgacgtggaaatctaccaaaaaattcgaccttatcgtatcgaacccaccttattttgaacatagtctcgcaagccgaaataagcaacgagatcttgcaagagctgtgacttatagccattttgattggctaaaacgggctcaacagtggctaaccccaaatggcagaattagctttattttgcctatcgatgctggaaaaaaattgttggaacaaagccatttattagggctatattgtattgaatactgggaaatctgcacaaaaatcggactatcacctaaacgagttatcctcactttttcaccgcaatatgctgaaatggctttgcagacattgacgatttatgatgaaaatcagcgatatactgctgactttactcagttcacagaaatattttacctaaaagtaaactctaaataataggtatgtggtaagtatgtatctatatgatacacataactagctctaaaattcccttgaaaactttcttatgtgcaccatatgatttaattttcacttcaccaacccaccgcttgcttgtaaatctgcgtggtaggaagagcggacgaaaggcccacaggcggcgtgttcaaagcccatttcgttggctttttcacggaacatatcaaattccgttgggtgaacgtaacgtgccacgggtaaatggtggcgacttggttgtaaatactgccctaatgtcagcattgtgacaccgtgatcacgcaagtcttgcatcacctgtaaaatctcttcgttagtttcccctaaaccgaccataatgcctgatttagttggaatatctgggaaaaccgccttaaattctttgagtagtttgagcgaccattcataatccgcacctggacgaatttctttatacaagcgtggcacgttctcaaggttatggttaaatacatctggcggattttcttttaaaatttcaattgcttgttcaacacgaccacggaaatccggcactaaaatctcaattttaatccctgggtttaacgcacggatctctttcacacattccgcaaaatgccctgcaccacgatcaggcaaatcatcacgatccacagacgtaatcaccacatatttgagcttcatatcctgaatggtttccgccagtttcttcggctcgtctttatctaaaggcaacggcttgccgtgagccacatcgcagaatgggcagcgacgagtacaaattgcacccataatcataaaagttgccgtgccgtggttaaaacattcgtgtaagttcgggcaagaggcttcttcgcacacagagtgcaagccgtggcgacgcataccgtttttgatactttcaatttttgctgagttggctggcagtttaatcttcatccactcaggttttttcagtaattcttggttgggatcgatatttttaacaggaataatggacgttttagctgcatcacgatatttcacgccacgttccattttaaaaggtgtacccattcgataattgtcctatttgttaataatttgttgcttattatagccgagaatttgggtaaagtaatcgaccaatttaggcgaaaccttgtcgcaatcggcttcagcttcagcgacaaaatcagctaattgacacatttccaatcctgcatagccacaaggattgatattgcgaaacggtgttaaatccatctggatattcaatgccagaccgtgaaacgaacagcctttgcgaatgcgtaaaccaagcgaacagattttcttaccgtccacatacaccccaggtgcgtctggtttgggataggcattaattccataatcagcaagggttttcactacacattgttccaatgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatctcgcacgctcaaatcgttaccttttgtcttgtggcgtttgatgtcgatcagcacatacataatttgctgtcctaaaccgtgataggtaatctgcccaccacgatccgattgtaccacggggatattcgtgggattgagcagatgctcaggtttaccggctgaaccttgagtaaacaccgacgggtgctgaaccagccaaatttcgtcggctgtttgttcatcacggctatcggtaaaatcctgcattttgtgccaaatttcttggtaatcttgcacaccaagttggcgaatgataagttggggcataggttacaataccattctcacgccttcaattttggctaagtcggtatagagtgtttcgacttgttcgatattttcggcttgaatagtgatggatacagagtgataagtgcctttgccactctctttaagagatggattatagtcgcctttaaccactttttgtacttcgctaacgacatcatcgattaaaccttcacgagctacacccacgactttaaaggtgaacgagcaaggaaattcaagtaaatctttgagtttttgttgtggaatatcggctaaatttacgctttttgtttctgtcattttattgtcctttatgaatatgagagcggtgtgattttgcaaaaaatttgcaagatcgcaccgcttgtttgaatggcacactaaatgaagacaattctgataattacaagggtttaattaaacagacctttaaccgttaaaacgatccaatcccacgctttgccaaagataccagcttcttgaacatcgtgcattacttgtaaatcaacactcgccacatctttgccattgagttgataaatcacttttccaacgacctgccctttcactaacggagcttccaaatttgttttttctagggtgtagcgagctttaagttctgctgttttaccttttggaacggtaatgtaactatcttgtaatgtgcctagttgagctttgcttaaatcaccataatacaccgcttgttcaagcacgctttgccctgctgaaagtggtttgacagtttcaaagttagcaaatccccactgtaacagttttttgctttccacttcacgccctttataggttggtacgcccataaccactgagattaaacgggtattactattgtatgctgaggctacaaggttatagcctgcttgatcggtatgtcctgttttcattccatcgacattgatggatttatcccacaataagccattgcggttaggttgggtaattttgttgtaggtaaactctttttctgaataaattttgtactcttcaggcaagtcacgaatgatatgagcgccgataatcgccatatctcttgctgatgagtattgttctgggtggtctaagccgtgaactgtcgcaaaatgtgtgttctttaaaccaaatttctgcacaaatttattcatactatcaatgaacgtttgctctgaacccgaaatatgctctgcaatcgcaacacaagcatcattaccagacacaacgataatccctttgttcaaatcttcaacagacacctgctgattaacattcaagaacattttagatgagccagggaatttttgtccccaagagttttcggtaacggtgactaaatcgctgtttttgattttacctgttttcaaggcttcaccaactacatagctcgtcatcattttggttaaacttgcaggtgcttggtgttgatctggattaagactggctaatactgcaccagaattgtaatccattaaaatataggtttgtgcattaagttgaggggctggaataccataatcaatatcttgagcataagccatattcatacttgaacaagcaatagcacatagactgaccgttttgagtactttactttttaacatataaaaaatcctatctatttttctgaataactgaatacagtgtaacctaaacggttgagctgctgtttaacttgttgagcttcttcagctgaagaaacatcaataatcacttcatatctcttttctttcgtgacaatgtggctattcactgtcgaaatcactttctgtacttttttcgccatacgttcattcttaagttgagtgacctttaacacaaattttggctgagaaacaaccgcttgcggtgtaggttcggtatcggctttaatggcaagtgtttcaccatcccctttcactttaaggttcaacccttcttgttgtgcaatttgatagagtgcttccgcccctttcccgataatatagccttctttatctacctgcatagcttccactcgtacttttgctgtaccagcacccaccataccaatcactttagcagcacctttagataaatcaataatgcgagttttactaaatggcccacgatcattaatccgtactattacttttttgccattgcgtaaatttgttattaaagcataagatcccaaagcaagcgttttatgagcagcagtataaccatttttatcaaaaatctcaccgcttgctgttctgcgtccgtggaatttatccgcataataacttgcagttccaacttcgctgtactggcgagaagcttctttacccattaccttatgcgttgtccccttctcttgataggatttttgattatttgatattttaacgcgttctaaatctgctccttttaccccataaagtttttttgtttgattatcactaggaacggttgtttttgtacttttagtgttagagcttacagctttcttctttacctttttcttagatactactttttttgtcgattttttctttacgataagctgcgttttagttgtttgcttctttgtatttgttgccattgtttccaatggtgtaaacattatcattgcagctaataatagcgtaacaattttgcctattttcattaaattccccttttaatcatagaatatttatttttctgctaatttatatggattacttttctcttttcgttcacgatgaacataactcgacatcattaacccaaaagctgccattaaggtaacataagaggttccgccataactaaacaacggcaatggaacgccaactacaggtaaaataccgcttaccataccgatattcacaaacacatatacaaataataagagagcggttcctcccgataaaattcgtccaaaggctgaggcagattttgccccaatcattaatccccttgcgataataaataggtaaatagctaataataccaaaacaccaattaaaccaaattcctcactgagtaccgcaaagataaagtccgtatgcggctcgggcaaaaaatctaactgagattgcgtgccttccatccaaccttttccttcaataccgccagagccaatagcaattttggattgaataatgtgataacctgttcctagcgggtctttatcgggatcaattaacgtcattacccttgtcttttgataatcgtgcatcaaataaaaccacattatcggaataaatcctgctagaaagacaataccagccccaataagtttccaacttaacccagcaagaaataaaacaaacagcccagcggcacaaactaaaatagaagtacccaaatcaggctgcattgcaactaataatgttggcgcaataataatcgccagagcaatactggtatcgcgtagatttggcggtaaggaacgattacctaaatagcttgccaccattaacggtacagaaagtttggcaatctctgagggttgaaatcgaataaatccaagatttagccaacgttgcgcacccttactgatttcacctgccacatcaaccaaaatcagcaaaataatacaaaccacatataggcagggtgatactttttcgtaaaaacgaggggggaacatcgccatcacaaacattacccctaaacccagacacacttggattactctgttggtaaacattttttcactgccaccgcttgcactatataagactaacaaaccatagccagtaattgccagcaagccgattaatagccataaatctaaggcaaagatcttccaaaatcgtcctaaaaatgatgatttattcactcaattcctctgcttctgggggttcacgttcttctacaggcaacggtgctgtagcttcggtttggtgtaacaaagcataatccataatctgtcttgctatcggtgctgcggtactaccgccaccgcccgcattttctaaaataatggaaaccacaattttagggttatcatagggagcatacccaataaaccaaccgtgatcgtgtaaattcttttttaaacctttggcatcataactttgtccgtttaaactaaagacctgagctgttcctgttttacctgcagctcgatacgcagtaccagcaaaggcttttcgcccagtaccgttgctcgcattaattacgttatacatacccagttttgagatctgccaataaaggcttggcacatcagaaatatcctcgtataacaacggatctttataaggaataagctcactcgacattatctctttcatcaagtgaggcgtattcacccgcccattgttaatcagcactgccgttgcttttgccagctgtaacggtgttgaaatccaataaccttgcccaatgccgacggaaatagtatccccttgtaaccaagattttctataacgtttctgtttccactcacgacttggcataattccgacggactcttcagccaaatcaatccccgttttcacaccaaagccgaatttcttcatccaatccgacatcttatcaatccccatatcataggcgagttgatagaaaaacgtatccgacgactcgacaatcgccctattcacatcagttctaccgtgccccccttttttccagtcacggaaacgctgtgtagaaccaggtaaaatccaaaaaccagggtcataaattgtcgtgtttggagtaatcttaccttccgttaaacctgctactgccataaacggcttaatggttgaagcgggtggataagtcccttgtgttgcacggctatacaatgggcggtcaggatcttctaacaactgcttataatctttacccgacaccccatcaacaaacagattattgtcataacttgggtttgtcaccatcgccaaaatactgctgtcagtcggatctaaaacaaccaccgcccctttctgattatccaataagttcgccacatggcgttgcaaatcaatatcaaggctcaaacgaatactgcttccagccactgcaggctgatcacgcaatttacgaataactttaccacggttattaatttccacttcctcaaaacctgttacaccgtgtaactgctcttcataaaatttctcaatgcccagcttcccaatatcgtgcgaacccgcataatttccaaatttcccttcctcttgcaaacgtttcttatcccgatcattaatcttcgcaacataaccgaggatatgggtcaaaatatccccataaggataatttcgtttaaaataagggtgaacgtccatacttggaaaacgatactgattaaccgcaaaacgagccatctgctcttcggttaaatcaggctttaataaaatcggagtataacgagttgtacgttttttctctttatgaaagttctcaatatcttgatcggttaaacccaccaataattttaattcttcaagggtctgatctaggttatagatcttctctggcacaatatacaaaccaaaataggtcaaattttcagctaaaaccttaccatttcggtcataaatcagcccccttgtcggaggcacaggcaataacttaatccgatttccatcagaacgagtttgataagaggcataatcaacaatttgcaaatgataaagatttgttagcaaaatacctgttaaagcaatcacccccacaaacgcaatcaaggcgcgacgcacaaacagatttaactctgcttgcccgttacgcaccttgtcataattttgcggttttgcgaatttaccaaacatttgccattattctcgatgataagggtgatttgttgtcaaagaccacgcacgatataaactctcagccaccaccacacgcactaatgggtgaggcaaggttaatggcgacagcgaccaactctgctctgccgccgctttacattcaggtgaaagcccctctggaccaccaatcaatagacacacatcacgcccatcattcttccagctctctaactgctgggcgagttgctctgtcgtccaaggcttaccaggaatatcaagggtcacaaccttcgcacgcccacaagctgccaacatcgccttgccttcttgctctagaatgcgtttaatatccgcattcttaccacgcttacctgcagggatctcaatcagctcaaaaggcatatcttttggaaaacgacgctgatattcctcaaaacctttggtaacccaatcaggcattttagttcccactgccactaattgaattttcatctacacccaaagtttttctaattgatacatctcacgactatcttgttgcaaaatatgcacaatcgcctgcccaaaatcgaccacgatccagtcagcaactgctttaccctcgtgagcaaacacgtccacaccagctttcttactttccacaatcaaattatctgcagtagaagcaacgtgacgacttgatgtccccgtacacacaatcatcgtttcagtaatgctcgatttccctcttacatcaatcgcttgaatatcctgagctttcagcccttcgagggtttctgttaaaaattgaactaaatttatggtcatatcttctattcagtctatcaaaaattggtggattatagcatataaaaggacgcgatcaggaaaaagtaatatgtttacaaaggtttcataagtatcatctctcttatatgatgatttaactatttacctgtaatagcaagtatctacttatcagtatttaagaaagtcataatataaatgcccacactatatcattaacacttaatagaaaaatcctattacagatgcatgaattttaaacgtacaacaaccattattaatatttttatttgacagttaaattaaattaattagaatagggtaaaaaagcattatgacacaaatgacttactctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcaccatgttaaatctctttgagaaattctgttaaaaaatcacttaattaataccccgaagtttgaaaattacccctagttatttccgaagaggttttaatgctctttccgacactctcgtctggcatactaattcaacgctataaacgtttcttagctgatgtaaaacttccaaacggagaacaaatcacaattcactgtcccaatactggagctatgactggttgtgctaatcctggagacattgtttggttttcaacatcaaataacctcaaacgtaagtatgcctatacttgggagctcactcaaactcagtcaggtgattttatttgtgtaaatacacatagagcaaaccaacttgtttctgaagcattaaagaataaatggatccgtgaactcgtagattacgatgaaatcttacccgaacagaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggtcaagaaaatagtcgcattgatttcctcttaaaacaacaaaatttgttggactgttttgtagaagtaaaagcaactacgctactcactgaaaacggtattggaatgttccctgatacaaaaactgaaagaggacaaaaacatctaagagaattgatagcaatttcccagcaagggcaacaggcagtcattttttttgctattttacatacaggtattaaggcttttgagatagctaagaaaattgatgcaaaatacgctcaaatttttaaggaagggatggataatggggtaaaaatgttggtatataaaactgaaatgcttttctctggaaaaacaccaacaggaatagaattaatcacccctttaatttagacactctaaatatttttttaaaatagcattaatcgcattcgcatagctttcagattttgtgccaaaaataacgtgtacgttattttcaacaatttgtaccacttctgcggcaccaagtgcttttaagcctttgcggtcaattttatcttttgatttcagttgaactcttaatcgtgttaaacagaaatcaagaaattctatattttctgcaccacctaatgcagtgataattttaggggcgatttcatcggcagaaagagaaagttctaccgtttctttttctgagttaaacaggtttttaataaatttgaacatagcgaactcctataaagtgaaatatgaacagcgtatattttagacctaattatgataaattctattcattttacaaaaatattggttaatattaccgcttacacttgaaactgatgatattgcccttaaatatgcacgcagttttttagaaaaataggaatttcaatgacaacgatcgtatgtgttcgcaaagatggcaaagtcgctatcggcggtgacggacaagctactttaggcaattgcgtagaaaaaggtacggtgcgcaaagttcgccgtttatataaagataaagtggtaacaggctttgcaggctcaacggcagatgcctttattttgcgtgatctgtttgagaaaaaacttgaattacatcaagggcatttagtcaaatctgcggttgaacttgcaaaagaatggcgtaccgagcgctcacttcgcaaattagaagcgatgatgatcgtcgcaaacgaaagtgagtttttgctggtttcaggtagtggcgatgtaattgagcctgaatttgatgtattagccatcggctctggtggtaactatgcaaaagctgctgctcttgccctattaagaacggaaaataatctttctgctaaagaaatcgtggcagaagcgttaaaaattgctggggatattgatatttacagcaaccataatcacgtgattgaagaagtatagtagagacacactgcgtgtgtccaaaaataaatatattgatgtgaattaacggacacacgcagtgtgtccctacaaaatggaataaaactatgtcaatgacccctcgtgaaattgtgtctgaattagacgcacatattatcggacaaaatgaggctaaacgagcagtagctattgccttgcgtaaccgctggcgccgtatgcagttgccagaagaactgcgtcaagaagtgaccccgaaaaatattctgatgatcggtccaacaggcgtgggtaaaaccgagatcgctcgccgtttggcaaaacttgccgatgcaccgtttattaaagttgaagccacgaaatttaccgaagtcggctatgtgggtaaagaggtggactcgattattcgtgatcttgctaatgtttcaatgaaattggttcgccaacaagcggtcgaaaaaaaccgtatgcgtgcgcaagatgcagcggaagatcgcattttagatgtgttattaccgccagcgaaagatcagtggggaaacgtgcaagagagcgataacacttctactcgccaaatcttccgcaaaaaattgcgtgaaggtcagcttgacgataaagagattgaaattgatgtcgcagcccaagtgagcgttgaaatcatgactccaccgggtatggaagagatgacttctcaactgcaatctctctttgagggaatgtcgccaaacaaaacgaaaaaacgcaaaatgaaaattaaagatgcgttaaaagtgatggtggacgaagaagcggcgaagctggttaatcctgaagagttgaaacagcaagcgattgaagcggttgaacaacacggtatcgtctttattgatgagattgataaaatctgtaaaaaaggcgaacacagtggcggtgatgtttctcgtgaaggtgtgcaacgtgatttactgccgattatcgaaggttcgacagtcaatactaaacacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaacacggtatggtcaaaaccgatcacattctctttatctgttctggtgccttccaagtggctcgtccgtctgatttactgccagaattacaaggtcgtttaccaattcgtgtagagcttaaatcacttaataaagaagatttcgagcgtattttaaccgagccgaatgcgtctttaaccttacaataccgtgagttaatgaaaaccgaaggcgtggatattgagtttaccaaagatggtatcagccgtatcgccgaatccgcattccgagtgaacgaaaaaactgaaaacatcggtgcaagacgtttgcacaccgtgttagaacgcctaatggacagtatttcattcgatgccagcgaacgttcaggcgagaaaatcgtaattgacgagaagtatgtgtctgatgcgttgaatgatgtggttgagaatgaagatttaagtcggtttattctttaactatatacttacagtacaaatggaaattaaaattacaaaaatatgcattacaagcggtgaaactctctcaattttttacaaaattttgctacaatctatccactcacattccatttgcaaagagatgaataatgacaaacatcagcacttttaaccgttcttggtcacgagttattttaaatgctttactccgctacggcgtaaaacatatttgtattgccccaggttcacgctcaacgcctttaacccttgaagcattacatctgcaaaaacaaggtcaagctgaatgccatagccattttgatgagcgtggtttaggcttttttgcactaggacttgcaaaagcaacgcaagatcccgttgcaattattgtaacttctggaactgcggtctctaatctttaccctgcggtgatcgaggcgagtatcacacaccataaacttatcgtgctttccgcagatcgcccccttgagctgatcggctgtggggccaatcaagcgattgaacagcaacatatttttagtcattatcctattgcaaatctcaatttaccaaaaccaagttcgcaatatagtgcaagctggttagttggtcgtgtagagcaagcctgttctaaacaagctcaaaaaggtggtgttatccatatcaatgcgccattcgcagaaccgctttatgaagctgacgaggagagcattgggcaagatccgtggttgctcgcaattcaaggttggttgaataaacctcaggtgaaatggtacgatcaacaagcgacccaacaagatgtgttgatgcacgaaaattgggattattggagaaccaaacgtggtgtgattgtggtcggtaagttaccgcttgagcagggaatgggattaaaactgtgggctgaaacgcttggctggtgtttgatcagtgatgtgcaatctggggttgatgcctctctgccttatgcagatatttggctgtcaaacaaaacagtagagcaacgtttattacaggcagacattgttattcagtttggctcacagattgtgagcaagcgagttaatcaatttttatcggcttttaaaggcgaattctggctggttgaggaaacgacagattatcttaacacctatgctcatcaacaaacgcgttttgtggcaaaagctcaccactttacccgtgttcacccgccacttcgtcaaaaaccgtggctgttggaacctttggctctttctcaattctgtgaaacctttattgaacagcaagtgggtggcaatctcaatgaagcctctctagcacatcatatcgaacgtgtattgccagctaatggtaatttatttattggaaatagtttatttgtccgcttagttgatgctttgtgtaaattgccagaaggttatccgatctataccaatcgaggtgcaagcggtattgatggattaattgcaacccttgcaggtattgcaaaaggtagcggacagccgacagttgcagtgattggggatatttccgccttgcacgatttgaactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttacgccagattagccagccgaccattttatttgtcattaacaataatggcggtgcaatttttgatatgcttccggtcgatcaaaaagcgaaagataaattctatcgtcttagtcataatcttgagttttcacagattgcgacaatgttcggtttagagtatctacgtccttatacttgggcggatttgggaacaaaacttaaacaagcctatgctcgtcgaggtgttactattgtggaaatcaaggtgaatgatcaggaaggtagtagcctttataaatccttgattgaacagatctctcgtgcttctatcgactaatgttagcaacaacttggcacagtcattcaggaacacccgtggtctttctccacgggtttcttggttctcaacaagattggcaacccgtcctctcgctattgcaaaatgagattgcaatccgaccgcttacccttgatcttgctggtcatggtcacagccaagctatctcgtgccacagttttcaacaagctagagaacagcttcacttcaccttgcaacaacatcttgctgaacagactttctatcttgtcggctattcattaggcggtagactagctttagattacgccctcacaacacaaaatccttatcttaaagggatcctgctcgaaggggcaaatatcggcttaatcagcgatgaagacaaaaaagcacgttggcaaaatgattgccattgggcagatcgcctaagtaatgaaccgcttggaaatgttttagaagattggtatcgacagcctgtttttgccaatttaagcgaaagcaagcggacagatttcatcaaaaaaaggctaaataatcacgggcaagcactagctcaaatgctcaaagccactagccttgcaacgcaaccctatttttcccctgaacaacgtcgtcagtttcacggaaaaatgctatttattataggagagaaagatagtaaatttcgtcaaatggcagaacaacatcagctcccctatcatcaaattgcaaatgcaggacataacacccattgtgaagacccaagtgcatttgtcaaacatcttattcagtttatatcaaagtaggaattacaatggctttacatcgttgccccgaatgccgtaaaaaaatcagtgaaagtgccgttacttgcccacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttacttgcccacattgtggcttctcgttcaatgaagctgatttggaaatttataaacaaaagctagaacaacgccatttacataatcaagagataaaccgcaaaagcgtcaaacttcacttgatttggttagctatttttgtgttggttattgggctggcaagtttattatctgtataaatgaatgatgatgtaagtataaaaaaggatagtagataaaactgttgtcccaagaataggcatagtagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctattacacctaaaattatggttatactttataacgtatatttataattcttctgcttgttctaggattttatcttgctcttttattaatttttctaatttctttttttctcggttagcctcatcttctgcttcccatacatcataagcttgaacaatttttgcaacgacagggtggcgaacaatatccttactgtcaaaaaagttaaaacttaactctggaacctcttttaatacttccattgcgtgttttaagccagatttttggctacgcggtaaatccacttgagtaatatcgcccgtaatgactgctttagaattgaaaccaatacgagttaaaaacatcttcatctgctcaatggttgtattttggctttcatctaaaataataaaggcatcattcagtgttcgcccacgcatatatgcaagcggtgcgatttcgatcacatttcgctccatcagcttttgtgccttctcgaaacctaacatttcaaacagtgcatcgtaaagtggtcgaagataaggctcgattttttgccctagatcccctggtaaaaaaccgagcttctcaccagcttccactgcgggacgagtgagcaaaatacggcgaatctcttggcgctcaagagactctactgctgcagcaacagctaaaaaggtttttcccgttcctgcaggcccaataccaaagctaatatcgtgacttagaatattacgtaaataggcttgttgatgttcgccacgtggtttaattacgccgcgttttgttttaattgcaatttcatgagccgaacttgtccactgattttgcaacaacattcggctttcttgaatcgctaaatgaacatcttccaaatctagttcttttacttttcctttaattggagcagtttcgttgtaaagttgctgaattaatttcgcacaattttttaataatgttgcagaataatgattttcttcaactgcttgaatagtaaaggtaaatgcattacgcgcaacaataaggttaaaacttttttcaataagggtaagatgctcgtcaaaagaaccgcataacgattgaagacgagcattgtcttgaggctcaagagtgaaaataagttcgttcaaaggatttcctctattttgtactgattctcagcgacttttaaaattcgccatattttaagtgatcttagcacaaaattatagtagaatacctctgttctcatcggggtgctttgtatagcaaggctgagaaatacccatagaacctgatctgactaatatcagcgtagggatttgagacagacaatctatatccgcctgttttagatccttctattttcacttttagaaggaatattcaatgaaattcaatcttttcaccctttctgcgttagccgttgcaaccaccacttttgctcaacagccaacactcacggtttatacctatgattcttttgcttcaaagtgggggcctgctgctaaacttgaagcgctatttgaaaaacaatgccaatgcgatttgaaatttatgccttttgaagatggggtaacaatgttcaatcgtattcgtttggaaaaaaataagactaaagccgatgtaatgttaggtatcgatcatttcttaatgcccgaagctgaaaaatcaggcttatttgtagaacacaatctgcaaaacaatgccaataacttaccgcttgaatggcgaagcaaaatatttttaccctatgattttggagaatatgcttttatctacaacaaagaaaaagtcagtaatccaccaaaaagtttaaaagaacttgttgaacgccaagatcttaaagtgatttatcaagatcctagaactagcaccgttggacgaggattgctcttttgggtaaatcaagtttatggcgaacaggcagaatcagcgtggcagaatttagccaaacataccgtcactgtgggaaaaggctggtctgaaacttatggtgcatttttgaaaaacgaagcagatttggtgttgagttatacaacatctccgctatatcatcaatggcacgaacagacggataaatacgtcgcggcagattttgcagaaggacatttagtgcaggtggaagtagccgcaatcacaaagagcagcagacaactcaaattagctcaacagtttctaagcttcctacaacaaccagaatcgcaacgaattatttcttactataatgtaatgaagcctgttgtgactactaaggcagatcctttatttaacacattgccaacttatcaaactataagtttcactcttcctgataacagtgagataaagcgctggataaatacttggttaaatactgttagccaatagtttttagaatggctaaataagctcaaaggtcacaataacctaccccaactcctgcggatcaatatccaccgtcagtcgaatatcgtttcgcaggaactgttctttttgctcatcaaaacgatctaacaactgttggatcgcacttcttgccgaatgttgaattaataactgccagcgataatgtcctgctttttttgccatcggagcattaaaaggcccaagtaactgaaagccttgccagccgttttcgctgataatttggtgtaaacaagcggtcaaatcttgcagaaaatttgcaactttgtcgccatctctacccgttgcacgaataagcacttgtgaagaaaacggtggtaagctcattatttttcgcatcgctaaggcttggctggcaaaggcaaggtagccgtcgttgagtaagctggtgagtaacgggtgatcggggtaatgcgtttgtaacaccacttctccttgcttttccgcccgtcctgctcgccctgacacttgtacataaagctgtgccaaacgttcttctgcacggtaatcggtggaaaacaggctactatccacattcacgatggcgactaaagtcacattcgggaaatggtgtcctttggctaacatctgtgtgccgatcaaaatttggcttttgcctgcttggatttcggcaaggtgttgttccaacgagcctttacgggcagtgctgtcacggtcaatacgagtaatgctgtattgcggaaaacgctgtgccagcacttgttccagctgttccgtgccgatccctgtggtaatcaaattgactgagccacaatgtccgcactgacgtggaatggctttttgcgaagcacagtgatggcaacgcaatactcgctgtttttggtgataggtaaagggcttatcacaggacgggcaatcggcaatccagccacattcgtggcaaagtaaaacaggggcaaacccccgtcggtttaaaaacaacatcacttgattgcctttttccaagtgagcttgcatcattgctaacaacttttccgataagcccgaataaatccgctgttttttcaaatcaattaaggtttgtttggaaaaatgtgcattaccagcccttgcagtaagctgaagttcgataaatttaccgttttgtacattttgcaaactttcaaaactaggcgttgccgagccgagaatgataggaatgttgttatttttcgctcgaagcactgccagatctcgtgcgtgataacgccagccgtcttgctgtttgaacgagccgtcgtgttcttcatcaatgataattaagccgagttgctgaaactgtgtgaacaaggcggaacgtgtgccgatcacaatcgcactttcgccgttttttgcccgaagccacgcattgagccgttgagtgtcgttaagatgcgaatgcaatgcgtcaatttccacgttaaaacgagcttggaaacgttgaatagtttgtggggtcagcccgatttcaggcacaagcaccaacacttgctcgccccgtttcagcacttcttcgatcacttgcagatagacttccgttttccctgagccagtgaccccattgagcaaaaacgctccgaagccttgttgataatgcaaacggctgacgacaagggtctgctgtttattcaacgttaaacggttttgagtgttgcaaatcggctgttcgcctaatttttcctgccagctttgcacgttaaaagggatttccagcttttccagataccctttttcaaacaaagctttccataccgcagggctacaagcggtcggtttttcaaagaaatttgcaaattccgccagtttgcttaatagctcttgttgtttttttgccttttgaaccacgccgttggatagagcttttctgccgttttccgtgacaacaaaatagtcgggagcagtgcgttcactactttccccttgtcgtagtttgacaggcaaagcactttgtagcacttcgccgaaaggggcgtgataataacggctcgcccactgcaagagttgccacatttcagcgtcaaacaacgcttgttcatctaacacttgctcaatcggtttcagtttttcggtgggaatatctgatgtggttgggaaatccaccacaatcccgattttacgctggcgaccaaaaggcacaacaaccctagcccccttcaccacattttcaaaatgcgttggaagcaggtaatcgaaataacgtgccaacggcacaggtagagcaattcggatgaggttcattagggtttcactttgcgaaaactatcaacacttaataagataatggataccgccaaacacgccattaaaatataggattttgcttctaatacttcaccaatggcaaaggaaataaataacattaccaaaggttcggcatagccaagtaatcctaacacattaatcggcagtaaattacttgaagcgatatataaaataaatgccattccattcaccagccctaataatgctagataaaaatagagatattcattttgcattaaaatagaggcttgatcaacttgagcaatataataaatggcaaagggtaataacaataataattctacaaagaaagtggctaaattattaatatgaaaatagcgacgtaagacaatataaatagggtagccaaaaccggcaacaaaagttgcccacgaaatacttgcggttaaaaagatattaattgtgacaccaatagttgcaaaaaataaagcaagccattttaataaagtaaaatgctctttaaaaaccagtttgcctaaagcaacggcgacaatcggtaataatagataaccgatagaaacttcaatagcttgattattattcggtgcccagagaaataaccaaagctgaatagctgtatttaatgctaagagcagaagaataaaaataagataaggtgtctgttttactctataatataaatctttaaaggctttttgttgatgaaataaaaagatcaccagtaaaataaatggcattaataccacaatacgaaagccaaaaatactatcgctttctaaagggcgaagtaaaaccgcaaaataatagccagcaccaaataagatatttgcagaaagtgaaaataagatcccttttaacattattccccccggcgctgtttacgaatagcaataatgccatcaagcactaatagacatatcgacagcatcaaacacaccattaaaatataggaagattgatctaacacttcgccaataataaaggcaacaattagcattgcaagcggttcaatatagcttaataatcccaaaacattaatcggcacaaggctacttgccattatatagccaattaatgccgtaccactgacaatgcctaataacactaaccaaaaataaaaattcggattattttcggtgacaaattgcatatcggtattgagcataaaataagtggctatcggcaacattaatataatttcgcagacaaagctggataaatgcgacatatcaaaatgtttacgcaaactgaaataaacagggtagccgattaataccattgaggtagcccaagagagtgagcctgcggtcattaacgtaatgaatactccaacagatgcggaaataattgagataatttttaagagagataaggtttcattaaataaaaatcgcccaacggcaaccattgcaatcggcattaacagataaccaatagacacatcaatggcataaccgttgtttggggcatacagaaaaagccacatctgcgagcctgtgaccgcagtagttgttaataataccaaaattaaatgggggtgctgttttaggcgttttaaatagcggttaaattcgtcgttttttttgaaaataaagagtgcagaaatcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattaatcctgacgataactctgcaaaaacttcgctaatcgaccaatagcttcttccagttgatccacatacggcaatgtcaccacacggaagtggtctggtttatgccagttaaagcctgagccttgaaccagcaacactttttcctgttgaagcagatcgtaaacaaatttttgatcgtctttgataccgtacatttccgtatcaattttcgggaacatatacatcgccccttttggcttcacacagctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttggcttcacacagctaatcccagggattttggtgagcaattcgtgagccttattacgttgttccaataaacgaccacccggtaagataaattcgttaatgctttgataaccgcctaacgctgtttgaatagcgtgttgcatcggggtgttggcacataaacgcattgacgcaagcatatctaagccttcaataaagccttttgcctgatttttcgggccgtttaacaccatccaaccttgacggaaacctgccacacggtatgcctttgacaaaccattataagtcaccgttaaaagatcaggggcaagaggggcaagatgatgatgtaccgcaccgtcatagacaattttctcgtaaatttcgtctgagaaataataataactgacggctatacactgctcccgttgggttattcgggttaatcaccaaaattgctttggttcttggggtgattttcgatttaatatcttcaatatctggaaaccactcattttcttcatcgcaaaggtaatgaaccgctttaccgcctgcaagggttgccgccgctgtccaaagtggataatctggcatcggaattaaaatctcatcgccatcatttaacaaggcttgcattgacattgtgatgagttcagatacgccgttaccaatgtaaacatcaccgacatctaaatcacgcataccttttaattgataatattgcacaatcgccttacgagcagagtacaaacccttagagtcgcaatagccttgagcggttggtaagttacgaataacatcaactaaaatttccgcaggggcttcaaaaccgaatggggctgggttaccaatgtttaattttaaaatcttatgcccttcttcttccagacgggtcgcttccttatgtataggcccacgaatatcgtagcggacgtgagctaatttatcggtttttgcaaagcgttccattgtttctccctaaaatagagggttaattatctgttaatttataaaaatctctctactgtactccgatttgttaggaaaaaaaagtggaaataggctaaaatagacttctttttgtcaagcggtgagatttttaggattttttgcaatgtctgtgtttagtcagttaaagcaacaactttatcaacaactacaacaaaagcctgtggcacaaggcttagtacagttgcaagcagaaattgcaatagaccttgaaaatcaacaattactagcttggctaaaagcacaaccgcttttcccccactactactggcaaaatcgagatacagaacaaacgatagtggcagtcggtgcggtacaaacctttgagcatttagacgacatagaacaatttagcaaacagtctgatttaatggtcgtcggcggaatagaatttgaaggacaatgccattttgtgttgccacgcttgctgttagtaaaaaatgagaagaaaatcaccgcttggttaaatctagatggtcgccattttgaaagcgaacaaaaggaatgtatcgctttgttagctcagtttgagcagacagccgaacttcaccccattgaaaatagcttgttaagcacaaaagttgcctgtgatttttcacgttggcaacacaacattgaattagcgattgaacaaattcaacaacagcaaatgaataaagtggtgttagccaatgcgaccaccaaaacttttacacaccacatttccccctacgttctgctttttgccagccaacaaaaaaatctaggctgttatcatttcttatggtcggaaaaacaaggggaagcctttatcggctcaacacccgaacggctctatttacgccaacaacgtcaattttttaccgaagctctagctggcacagtggcagtgacggacgatcctgttcaaacggaacaaaatgccctatggctactcaacgatcaaaaaaatatctatgaaaattggctggtcgtggacgatatttgtagtcatctggctgattgtgcaacggatattcaagtcagcgatgcagagatcaagcggttacataacgtgcagcatttacgccgaaaaatccaaacgcaactgacagaacaggtcagcgacgcagattgccttgctcgtattcacccaaccgccgccgtcgcaggactgccacgccctaaggcaaagcagtttattcaacaacaggaatgttttgagcggggctggtatgcaggggcattaggctatttcacccccgaacaagccgagttttgcgtaatgttacgttcagcccttattcaagctaatcaaattaccttttatgcaggggcaggaattgtcgaaaaatctgatcctcaatcagaatggcaagaaattgaccgcaaagcacgagcaatggcagggttaatggagtaatttctttttcatattttacttctgcgccttagattttcttcacaatagtcataatgtggtagtcgaaattagaataaacagactaggatatatctgttgagcttaattagaagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagtcagcaataagaaaccattgggggtagcacataacaatcagtaggggtggtgggactctaccttttagtaagcaggtgctaattattcattatattacagaaacattctatttattttacaggtatatcacgtagttttttaatgaatacaatttaatattgcataggatttataatatggtaaagaaactttcatttttgacgttattaatgttgttcattccagctacagcgtggttaattgggtggcaatggaatttgcaaactaatcttggtgttaatgttttcgattggacgttatttattttaacggaaacgggttcaacgccttatgcgttaatcacttgcgtgctgtttatgttgtggctgatgtggcttgcgcgcactcgctattcgtggtttttagtaggctttatttgtgcaacgtcggtagttggaacacaggcaattaaagagggggcgaaagcggtctttaaagagcctcgtccttttgtgacacagatgtttcaggcggatactgaggcattttatgctttacctaaagctgaacaggaaacggcggtattgaaatttgtgcaacctgaaaatcagtttgtggttgaacatcaagcagatgagctgggctactctttcccgtcagggcatacgatttttggggtatcttggctattgatgtttgcagggttgctgtttggtattcgtggacaagcggtgatttttgctcaattttttgtgattttgtgggctggtttgatgttgatcagccgtttgcggttaggaatgcattatcctatcgatctgtttgtcagtactttgattgcgtgggttttccacttgatcatcttcttatgggtaatcccactcttagaaaaatggacattatttaaaaagcgaggctaactatggtttattacggtttggatattggcggtacaaaaattgaattggctgcctttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgcctttaatgagaaattagagaagttacacagcgagcgagtgccaaccccacaaacgagttatgaggattggttaagaacagtggaaaccttagtgcgtaatgccgatgcaaaatttggcgagcacggcactgtggggcttggtgtaccaggttttgttaatcataaaactgggttagcggaaattgccaacattgcggtggttcacggcaataaaattattcaagatttggaagcacgtttagggcgtgaagtgcgtgttgaaaacgatgcaaactgcttggctttatcggaagcgtgggacgaaagcaatctgcaatattcaacggtgttagggttgattattggtacaggttttggtggcggtattgtgttgaacggtaaagctcactcaggtcaaatcggtatggctggcgaagtggggcatattcagcttaactatcacgcgttgaaattgcttggttgggataaggcaccgatttataaatgtggctgtggtaatatggcttgtttggatagctatatctcaggacgtggttttgagatgctttataatgatttagtcggcgaaaaagttgatgcaaaaaacattattcagcgtttttacgataaagatgagaaaaccgttgagtttgttgagaaatacattgagttaatggcaatttcggtggcaaattatattacggtacttgatccagatatgattgtgtttggtggtggtttgtctaactttgattatatttatgaagtcttgccaaaagccttaccaaaatatttattgcgtaatacggaagtgccagtgattaaaaaagcgatccacggtgactcaagcggtgtgcgtggggcggcagcgttattcttgaaatagtaggtcgggcatttatgcccgacaatcatttataaaataccgcaaagttaggcatttatacccgacaatttttcataaaatatggcaaagcaggcatttatgcccgacaatttttcataaaacacggcaatgtcgggcataaatgcccgacctacggaaaataaatatgcttcaaatcaccccaattccagccctttctgataattacatttggattttacaaaaagagtgccaagcgattattgtcgatccagcagaggctcaagctgtattcgcttttcttgcaaaacatcagcttaatcccaccgctattttgcttacccataatcatcacgatcatactgatggcgtggctggtttagtggcacaatttcccgatatgcttatttatggctcagaagaagtgagccaatttgccaatcagattgtttaccctgagcaacagtttgaactgttagggttaaaggtgcgagtgattgagagtgcagggcatacggcgcaacatattagctatttggttgataatgaatatctcttttgtggtgatgcgttattttcaggcggttgtgggagagtgtttacaggggattaccaagctcagtttgatgccctacaacgttttaaagccttgcctgattttgtgaaagtctatgctggtcacgaatatactcaaagcaatttgaaatttgccgaagcggtaatggcaacaagctgtagtttaatggaacatcaagagcgagcggatattttgcgttcacaacataaaccaacgctaccgagtacgattggtgttgaaaaacagattaatccatttatgcaagcggtgactttagatgaatttattatattaaggcagaaaaaagataatttttaatacatataagctaaatcctatctagcacatcattcttaatttcccctatctctcatcatatgatatagttaaaaacgttttcatgtttattgttcaaataggtaagttgctgtgaatatagatcttcaaaatatgcctcagcatgtggcgattattatggatggtaatggacgttgggctaagcaacgagggaaattacgagtatttggtcacataaaaggggtaaaagctgttcattcagctgttaattttgccttaacgcaaggaattaaggtattaacgctatacgcatttagcagtgagaattggtctagaccgaagttggaagttgccgcattaatgacactatttgtaaaaacattggatttaaatataaaaaaactacacagcaataatattcgcttaaaaattattggtgataaaactgcttttagtgaagcactgcaagaaaaaattgaactggctgaacaactgacaaataaaaacactgcattgactttaaacattgctgcaaactatggcggacaatgggatatagtccaagcaaccaaacgtattgcacatcaagtaaaaaataatgtcatacctatcgaagatattacaactgattaccagcacratttattaattcgtactagtggagaacagcgaattagcaattttttattatggcaaattgcttatgccgagttagtatttagtccggttttatggccagattttgatgaaaaggcatttacagatgccgttattgcttatcaacaacgtgatcgccgttttggtggttgttaatctataaggaaaattcaatgcttaaagaacgcattctttcggcaatcgtgatgattattttagcagtggttgcattgttttggctttcacccttagcttttacgattggcttatccgctattgttgtgttaggtatgtgggaatgggctcagtttgcgggttttaaacgtccgatagcacgtgctattgttgcttttgtggtgacctgtttattgatttttcctattatggcagaaacaagttatattcaagctacacgttttttaacagatgaaacaataccactattatttgtaggttgtttttggtggttcatcgcatttggattggttattacttatcctaattcagcttcaatttggagtaagtcagtagcagccaaatttatttttggtttttgtacactcgtcccatttttaatcggtactttagcgttacgtttttatcaatataatcttgaacaatatcagggaacttatttacttctctatgtgtttttattggtctggggagcggactcaggcgcctattttgtaggtcgtgcattcggtaaacataaacttgcacctaaagtttctcgaggtaaatcttgggaaggggctattagtggtgtgattacatcgactattattgcagctattttcnnnnnnnnnnnnnnnnnnaatgtatttggtcgtgagttgaatacgtctgcgtttnnnnnnnnnnnnnnnnnnnnnnnnnnnntttcgattttgggtgatttaagtgaaagtatgtttaaacgccaagctggtattaaagatagcagtaatttgattccaggacacggaggaattttggatcgtattgatagcttaacagcggctgttcctgtttttgctannnnnnnnnnnnnnnnnnnnnnnnnnnnnnnnnnnnnnnnnnnnnnngccttttttattctgatctgcgtgttggtattcgtacacgaatatggacacttttgggctgctcgtaaatgtggcgtaaaagttttgcgtttttctatcggttttggaaaagtattatggcgtaagaaagataaacaagggactgaatttgcattttcattaattcctttaggcggttatgtgcaaatgcacaatggcgaagcagaacatcaattgccagattcgcaatctttgcatacaaagactgttttgcagcgtgcttttatcgttcttgcaggcccagtggcgaattttttatttgcgattttggcgtattgggcggtgtttaatgttggggttccaacggttaagccagtgatcggatctgtgattccagattctattgcagcttatgcaaagctggaaacagaattggaaattaaaacggtagataaccgttccgttcaagattgggaagatgttaccctagctttgttgggcaagattggagaagctgaagttgttattgaaggcaaccatattgatgaaaatatttctcgtcaatttacgctagatttgagaaattggaatgttgatggaaataaggaaaatccgttaactactttaggtattcgtcctaaaagtgcgacggttgaaccaattattaaaaatgtagtcgaaaattcggtttcggcaagatcagggattttagctggcgataaaattatttctgttaatcagcaaccttttgaatggcgatatttgttagagcaggtgcaaacaggtaatattattgatttgacgattgaacggaataatcagcaattagcttttcagttgcagcctgaatattcaaaggaagatgagcgttatttaataggcttagtgccaacgtatcaaccattagaatcaaagtatcaaagtgaattaaagtatgatattctttctgcgcttggaaagagcttagaaaaagtcgtatcattaagttatacgattttacaatttattggaaatttaattacaggcgagctttctcttagtaatatgggcgggccaatttcaatggcaaaaggggctggggcaacggctgaaattggttttgtctattacttaggatttatggcattgataagtgtgaaccttgcagtgatgaacctgttccctattttgcctttagatggaggacagttgattttactagcaggggaagcnnnnnnnnnnnnnnnnnnnnnnnnnnnnnnnnnnnnnnnntttcaacagattggtgcaatgtttgttataggtttgatgttatttgcattatttaatgatttagtccatttataatcaagtggttagatttcaatattattttaccaacgaataggatcatttaaatgaaaaaactattactttcaacattattagttgcaaatggtgttgcttttgcttcaccttttgtgatcaaagatattcgtattgatggtatccaaacatctgtaagccaaacaatgatccctacattacctgtaaaagtagggcaactagcgactgataatgatattgcaaacgttattcgtcatttatttgtacaaaatcgttttcaaaatattagtgcaacccgtgaaggagatattttaattattaaagtagtagagaatccagtcatcaataatgttgatattgaaggtaattctgcaatccccaaggagccactggaacaaaatctaaaagcgaatctcatcactaaaggagaattatttaattctacaaagttagacgcatttaaatcagcacttattgagcattaccactctataggtcgttacaatgctaccattgatactgttataacaaactcagacaatggaggtgtaaatattaaattagatataaaagagggagatgttgcctatgtaaaagctattaattttgaaggaaatcaagcttttacatcaaaagtattaatgaaacaactggatattcaacctgatgtttcttggttcaatatttttcaaagtagtaaatttgaacaaacagcatacaatcaagatttagaaaatctacgtaatttctacatgaaccaaggatatgcaaaatttaatgttgaagctgaacaacccgtatttagtgatgataaaaaagaagtatctttaacatataaaatcaatgaaggaataccttatactgtaagtgaaatacgtattgttggtaatactgcaaaattagataacgagttaaatgaacagctcaaatattataaaacaggcgagctctttagcaaaaatgaactttcaaaaattgaagacaatattaaacaagtatttggaaataatggttttgcttccgctaaaatagagcttcatccaaccttcgatgatacaaataaaacaattcgtctcacatttgttgtggatgctggacaacgtgtttatgtaagacagattcgttttgaaggaaatgatgtgactgcagattcaacgttacgtcgagaaatgcgtcagcaagaaggagcatggttgtcaacaagtctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaagaacgcaatacaggaagtattaatttcggtgttggttatggaacagaaagtggtttaagttatcaagctgggataaaacaggataatttcttaggtatgggctctacaattagtttaaatggtacccgtaatgactatggtacaagtatcaatttagggtatactgaaccatactttactaaggatggagtaagccttggtggaaatatcttctacgaggattatgataattcaaaaaataatagtgtcgcaagttataaacgacaaacctatggagtcaatagtactttaggattccctgtaaatgaatacaactcctatttccttggtctaggctacactcaagatctgattaagaatgctcgacgtgaatttaatcgtgaactttatgtacaatccatgaaattcccgattgataatgacttaaatgtctataaaaaaattaaagcaaatgacttcgatttttcttttggttggaactataatagtctaaatcgaggttttctcccaacagaagggactttgacaagcattagtggacgtattaccacaccaggttcagacaataagtattataaagttagtattgattttaaaaactatttaccagtcaatcgcgaacataagtgggttatctcaactaaagcgaatattgcttatgcaaatggttttagtggtaaagaattaccattctatcaaacttatactgcaggaggtatcggctctctgagaggttttgcttatggagctattggaccaaaagcaatctatctgggtaaagataacaatggtaatatccgattcaattctgtaaatggagatattgttggcggtaatgcaatggcatctgcaactttagaattaattactccaacaccatttgtaagtgaaaaatatcaacataatgtaagaacttcattatttgtggacgctgcaacagtgttgaatacaaaatggaaaactaatccagtagtaaacgacattcaatataattattctagtttagaaaactttaaagattataaacgttttcgtgcatctacaggtatcgcattccaatggaattccccgataggtccattggtattttcttatgcgaaaccaattaaaaaatatcaaggtgatgaaattgaacagttccaatttagcattggtggttcattctaatcttataaacaagcggatagatttgttcatttttttacgagtctatctttcctaacttcagaaaggacattttaatgaaaaatttatttaaacttgccgcagttgcttcagctttagcttttagtgcgaatacagtaaatgcaaatgaaaaaattggatttgttgatcctaatttcttgatacaaaatcatccacttaccattgaagcaaatgataaattcactaaatttatgaaagacactgaatctaaatttgcaccaagggaaaaacaattagcagcagaaaataaagcattatctgatgaagaaaaagcattattggatgagcgtaaaaaaattgaagaagatgcacagaagttacaaaaagaacaagtaaccttagaagctgcaatgaagaaaaaggtagcccaacttgaaaaagatgcacctaggttaaaagcgaaagagatccaagcacgtcaggataaaattaacgcagaagctaaaccattccaaaataaagtttctgcattgcaacaacgtgaagtagaatttggaaaaaaagcagaagagttccaaaaacgtgctgatgagtttcaaaagaaagtagcggctttccaagaagaaattgctaaggtacaaaaagaatctggtgtaataactcctgaacaagtacaacaaaaagtcgttgaagatattaatgcgaaaattaaacaagtcgcggaatctaaaggctatactttagttcttcctccatcggtcgcattatatgctaaagatggaaatgcagcagatattacagaagaaattctagttgcaatgggtggaaaaatgccagaggctccaaaaactgaagtgcctgcagcggaagtcacaaaaccagaagaagtgaaaaaataatggctgaattccgtttaattgaattagcggagcagatcggcggtactctaaagggtaacgccgatttggctattttaagcattgctcctttagataaagcaacttctaatcaaattacctttatctctaatgcaaaatatcgtccacagttagctcaatgccaagcgggagctattattgtttctgaagctgatgtcgaattttgtgccgaaggtcaaaacttgatcgtggttggaaacccttatgttgcttatgcgattttagctcaatatatggatacaaccccaaaccctgccgaaaatatcgctgaaagtgccgtgatctcacctgatgctaaattgggtcataacgtttctgtcggtgcaaatgctgtgattgaaagtggtgttgaaatcggtgatgatgcggtgattggtgctggctgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcggaaaaaacagtaaaattggtgcaagaaccaaattatgggcaaatgtgtcggtttaccataatgtacaaatcggctcagattgtttaattcaatcttctgccgttattggtagtgacggttttggctatgcaaatgagaaaggtcaatggattaaaattcctcagactggtggcgtgattatcggtaatcgtgttgaaattggggcttgtacctgtattgatcgtggtgctttagatccaacggtgattgaagacaatgtgattattgataacctatgtcaaattgcacataacgtacatatcggttatggcactgcgattgctggaggtgtcgtaatggctggtagcctgaaagtaggacgcttctgccaaattggtggggcaagtgtaatcaatgggcatatggaaatttgtgatggggcaatcattactggaatgggaatggtaatgcgaccaatcacagagaaaggaatttactcatcgggtattcctttgcaaactaataaagaatggcgtaaaacagctgctcttgtaatgaatattgatgaaatgaataaacgtttgaaagcattggaaaaacgtttagctgaataattgattgaggtcttagtagtgacaaccaaattacaaacagaaaatcgtgaaccaagaattattgaagtaactgaaattatggaaatgcttccacatcgttatccattcctattagttgatcgtgtggttgattttgaagaaggaaaatggctccgagctgtaaaaaatgtgagtgtaaatgagccttgttttactgggcattttccaaatcaacccgttttcccaggtgtacttattttagaagcaatggctcaggcaacaggggttttagcaattaaaagctacggcaaattgaaagacaatgaactttactattttgcggctgtagataatgcacgttttaaacgccctgtagtaccaggtgaccaaatgattattgaagtgacctttgttaaagagcgtcgaggcattacggcatttacaggtaaagtttatgtagatgataagctagtttgcgaagcagacctaatgtgtgcacgtaaataatcttgcttgaataaagaggaaaatactatgccattaattgacgcttcagccaaaattcacccaacagccttgatcgaagaaggtgctaaaattggtgcaaatgtagaaatcggtgcattttgtgttatcggcaaagatgttcgcattggggctggtacaaaaattcactctcacgttgttattcaaggtgatacagaaattggtgaagataatcaaattttccaatttgcaagtattggtgaaattaaccaagatcttaaatatcaaggtgaaccaactaaaaccattattggacatcgtaaccgtatccgtgaaagtgtgactattcatcgtggtacggttcaaggcggtggtgttacgcgtgtaggtaacgataacttatttatgattaactgccatatcgcccacgattgctctatcggtaatcgctgtattattgcgaataatggcactttagcaggacacgttactcttgatgattttgtgattgttggcggaatgtcagctattcatcaatttgtcgttgtgggttcgcacgttatgttgggtggtggatcaatggttagccaagatgtgccgccttatataatggctcaaggcaaccacgcacaaccgttcggggttaatcttgaagggctaaaacgtcgtggttttgagaaagcgacaatgcatgcaatccgcaatgtgtataagctaatttaccgcagtggtaaaaccttagaagaagctattccagaaattgaacagtatgcaaaaacagaagcagcggtcagtttattcttggatttctttaaacgttctacgcgtggcattattcgttaatttgttcatgctctcttattgaggaattaaaatattcgagcatacattctgtatcaatagcaaaaatgtatccatataagacgttgttctaaagaatatagatacatcgatttttaatctgacatattaatagtagttattctataaaaacctgttgacaaatgttctattttagaggattctctcattcactttttacgcttaacatttagagaatagcgatgaaccgtttttctatgattattaccacgacgatgaccattatgtgcaaacatagtgcgggtgttcgtggctagaaaacggaacaatattcaacgaaacccgctttaacaagcgggtttttttgtaacaaaatttgcaaacattaactattatcttcaggagaaattatgcgagttctaaaatttggaggcacttctttagccaatccagaacgctttttacaagccgctgacatcatcgaaaaggcacatttggcagaccaagccgcaggcgtactatccgccccagctaaaatcactaaccatcttgtcgctattgtcgataaagcccaaacaggcgaatcctacgaatctcatctcaccgaagccaccgacattttcaataacatcatcaacggattatatgccgtcaataacaatttcgaccgtgaaggattaagtgcctttatcaaagcagaactagacgacatctgcaatattgcagctgaagcagcaaaaaataaattctgcccagataatatcggtgcaacagtgcatagccgtggggaaaaattgtcgattgcgatgatgaaagcgtggtttgaagcgaaaggttatgaagttactcgcattgatcctatcgaaaaattattagcacacgggagctatttagaatcttctgtggatattgctgaatcgaccaaacgtattgaagctctttctattccaaagaaaaacgtcgtgttaatggcgggctttacggcaggtaacgaacaaggtgaattggtgttacttggtcgtaatggttcagactactctgctgcctgtttagccgcttgcttaaaagcgaatgtgtgcgaaatttggacggatgtggatggtgtttatacttgcgatcctcgtttagtaccagatgcgatctgtttagagtctatgagctatcaagaagcgatggagctttcttacttcggtgcgaaagtgatccaccctcgcactattggtccgttagtaccgttaaacattccatgcttaattaaaaatacccataatccggaagcaccaggcacaatcattgacagtaatgtagtcaatgataatttaaaagtgaaagggatcacgaaccttgataatgtggcaatgttcaatgtttcaggctcaggtatgcaaggtatggttggtatggctgctcgtgtgtttacttcgatgtcgcaagcgggtatttccgtgaacttaattacacaatcttcttctgaatatagtattagtttctgtgtgcctgtaaaagcggtcgaaaaagcactctgtgcgttaaacaatacttttgctcaagagttaaaagatggctcgcttgatcctgtggaagtgatcaaagatctctcaattatttctgtggttggtgacggtatgcgtaccgccaaagggattgcggctcgcttcttctctgcactggctcaagcaaatatcagcattgtggcgattgcacaaggttcatcagaacgttccatttctgcggttgtgccgttaaataaagcgattgaagcggttaaagctacacataaagcgttattcaataacaaaaaagtggtcgatgtctttttagtgggtgttggcggtgtgggtggcgaattgatcgaacagatcacaacccagaaggaatatcttgcaaagaaggatattgagatccgtgtttgtgcattagctaactcaaataaaatgttgctcaacgaaaacggcttaagccttgataactggcgtgcggatttagagtcggcgacacagccatctgactttgatgtgttgctttcattcattaaattacatcacgttgttaatcctgtttttgtcgattgcacgacagcacaatcggtggcaaatctttattctcgtgcattaaaagaaggcttccacgtgattacaccaaataagaaagcgaatacctcaagctatgcttattatcaggaaatgcgtgaaaatgctcgtcaaagccaacataaattcttatatgaaaccaatgtgggcgcaggcttgcctgtaatcgaaaacctacaaaatttgcttgctgccggcgatgaagtcgagaaatttgaagggattttatctggttcgctttcttttattttcggtaaattagaagaaggttcaagtttgtctgaagcaaccaccattgctaaagaaaaaggcttcacagaacctgatccacgtgatgatttatcagggcaagatgtggctcgtaaattgctgattttagcccgtgaatgtggctatccattagagctggaagatattgaagtggaaggtgttttaccaaaaggtttctctgaaggcaaaactgcagcagaatttttagcgatgttgccggagattgatgtggaatttgcaaaacgtgtggaaaacgcgaccgcttgtggcaatgtgttgcgttatgtgggctccattgaaaacggtaaatgccgtgtcgcaatcaaagaagtaaacggtgatgatccgctttataaagtgaaaaacggtgaaaatgcccttgcgttctatacacgctactacagcccgattccgctattactgcgtggctatggtgcaggtaatgatgttaccgctgcaggtatttttgcggatattttgcgtacactgaattaaatctacatttgcaaaattttgttccaaactaaccgcttataacggatgccaagcgtggcgtccccacaaaaatggttataaaaacaaaggaaaaaaatgacattacgaatttatgctccagcttcaagtgcaaatttaagtgtcgggtttgactctcttggcacagccatttcgccgattgatggctcattactcggcgatgtagtacaaattgaagagtgtgatcaaccgtttgagttggaaagtgtcggttattttgtgcgtaaactgccgaaagaaccgcaaaaaaatatcgtctatcaagcttatgtactgtttagcgaacgcttgaaattgcgtggtggtgtagtgaaaaatctacgcctaacccttgagaaaaatatgccgattggatcgggcttaggctcaagtgcttgctcaattgtggctgcactcgtagcgctgaataaattccacgatgaaccgttttcaaaaatggaattgttggaaatgatgggcgaactagaaggtagaatttctggctcaatccattacgacaacgttgcaccttgctatttaggcggtttgcaactgatgactcaatctctcggcaatatctgccagccgattccgttttttgacgaatggtattgggtgttggcttatccagggattgaagtgcccaccgctgaagctcgtgcgatcttgccgaaaagctatacacgccaagagatgatctcacaagctcgctatttaggctctttcgttcacgcttgtcacactcgtcaagatgtacttgccgcaattatgatgaaagatctgattgctgaaccgtatcgtgaatcattactgccaaactttgccgaagtccgccaaggttgtaaagatttgggagcattggcggtggggatttcgggttcaggcccaactatgttcgccattgcaccagatttagaacacgctcaaaaactggtcgattatcttgaaaaagattatctacaaaataatgagggttttatccatatttgtaaggtggataatttaggagcgagagagttgaagtaagctcggcatacataattattctcatagactccgcccttattaagggcggaaaagcaagagaaaatataaaatgtcttagtaaagtaaattcctaccccctcaaatcattcgcctgttgcaataaattacggctctctttaaggaactgttcggaataatcgccaaaccaacaatgcactttttcaaaggcatcaataaagccctgtttatcgttttgctgaaagaatgccaagctcttttcaaaactctgttgtagcgaggcaatgacatctaaattttcaggcttatcggcaataatttccgcatacaatttcgcatcttgggcaaatagacgaccgatcatcgccagctctaaacgataaatcggtgacgaaagtgcaagtaattgtggtaatttgaccgcttgttgcgataaatgtaagccataagcaaaggtggaaaagtggcgtagtgcttgaatgtaggtcattgcgtgatcgtgttctgtggcatcgatctcttcaatcttcgctccccaaatccgcatttggtcaagcaaccattgataacgttcggcaaaacgcccgtgacaacaagcgatcacttgtttggcaaaacttgcaatatcaggcccaaacattggatgaagcccgacgacggctccggaatgcacttctaacatcttcgctaacggctgtgctttgactgaggtgagatcagctaagatcatctgttcgttcaaatacggctgtaaacgctcaagggtgtctaaggtgttggctatcggcacacaaaccaccactaaatccgctccgtgcataatctgttcggcttgctcccagtcatctcgatcaaggcgttcgaccgagtagcccgataattcaaaatagcgggcaaacagtccgcctaacttgcccaagccaccaacaaccacgattttccgcatttgctcatttgtcgctttaaagccgtgtttattctcgttggcataagattcccgcattagacgacgcaacacatcttcaatcaaatcagcaggaatgccctgactttctgcttcttgacggcgagcggcaatcattgaggcttcacgttcagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcataaatcggcaaaccgtgctggtgcttaattttgccaacttctgccaccagtgaaagacgttttgacaataattcaattaactgttgatcgacttgatcgatctgttcacgaataggatttaatgggttcatactactttcttagggtctctgcaaaatcggttaataaggtttccgttgtctgccaatcaatacaagcatctgtaatagatacgccatatttcatctgttcaaaaggttgctcggatgattgattgcctgcaaacaggtggctttcgatcattaagccgataatagattgattgcctgcgacaatctgttgtagcacattttccgccaccaacggctgacggcggtaatctttattagagttgccgtggctacagtcgatcataatcgcttcaggcaagccggctttgcgtaatgcttgctcgcactcttgcacatattgtgcttcaaaattcggggattttccaccacgtaaaataacgtgtccatcaggattgcctttggtttgcaataccgtcacttgcccctgttggttaatgccaataaaactatgccccattgcagaagcctgcattgcattaatcgccacgcccaaatttccgtccgtgccgtttttaaatcccaccgccattgataagccagatgccatttctctgtgggtttgagattccgttgttcttgctccaatcgctgaccaactaaacagatcagcaagatattgtgggctaatcggatctaaggcttcggttgcaagtggcaagcccagttcagctaaatccaacaataatttacgtgcaatgcgtaaccctttttcaacatcgaaggtgccgtttaaatgtgggtcattaattaagcctttccaacccaccgtagttcgtggtttttcaaagtacactcgcattacaatgtaaagtttatctgacactttgtcagctaacacttttaattttttggcatattctaatgcagatacaggatcgtgaatggaacaagggccgataacaataagctggcgtttatcacgtttatgaataatatctgagatcacttttcttgattcttcaatctgtttacgcagatgctccggcaacggaaactcttgttttaatccctttggcgttagcaaaactttttcattacaaatgtttacgttgtgtaaactatcctgattaaatacagtgttcatttttatttcctataattgtaaaaaaatcaatacagaggtaatttacaacgtaattggcaaagtttcaatggttttttgagtttaatctatcaagctgtcaaagccctataatatttcgggcggacacatcggtccgcccaaacaatgattttataaataatcttgaattttctgtttcacctgctctactgaaattctctccatcagtccatcacctttcgcacttgtcgcccaaggcaactgatcccaaggttttccacgactttctaatacaacctgatcataaacagacaccactttatctaaatctaaataagggcctgtacggcgtgggttatgaatcgcatatagaccaatcaccttcgtattttgagttgtcgcaatatgagctggccccgaatccgaagatagcaccaaatccgcttgacgaattaatgcggcaagttgttttaaattggtttttcctgcaagattaaggctgttcagtgcaagttgttgaatttttgctgctacttccatctcataaaccgatggagagcctgcaataatcacattgatgttttgtgctaatgcaaactgtgcaatttgcccataattttcaggcgaccaatctttctcttttttgctagaacaaggggcaatgactaaattttttctttgtttatcaataaattgcgacgtataggctaaatctgcttcacttacaggtaaatcccaagttgggcgtagatcttgcacaccaatcgctttagcaaacatcatttgaccgtctaaaacgtggggggaagcggtctgttccacctttttatttgtaaatagccactgtccttctcttgcccgatcttgattaaaacctactttctgttttgctcgaatacctaacgataaaatagatgcacgcaatgccgtttgcatatttaacagataatcaaaccgcttactgcgaagctgtttccataacgccaaaatccctttccatcccgtttttttatcataaggcacaagggttacattcggaatgccttgcattaacatcgactccgttttaccaataatccaagtgatttcagcttgcggatattggcgttgaatggcttgcacgacagcaagggtatggcaaacatcaccaatcgcagaaaggcgtaaaatacagattgattgtgggctgttcatcttcattcctataaacatttcgcaggttttggcaagcctgcaattttggttgcctgttttgctgggccttcggggaataaacgttgtaaataacggctactgcctttttcttcaccaaatttctgtgacaaggcttttaccagcattcggattgcaggggatgttttgtattcttgataaaattctcgcacaaaatagacgatttcccaatgggcttcgctaagttcaaggttatctttttgagcgataactacggcaagttcaggcgaccagtcgtctaaatttttcaaatagccgtgttcgtctgtggggtattgttgatgattgagttcgataaaatgaagcatacaagatggggtgtaggatgaaaactctaaaaaaagagcccagtattctaaaaagaacttaattaaaatgcttggctataaatatattacttcgtcaaatcaatctgataaatcgcaaagcctgtttcatcagtgccaacgaatgacattggatattgtgctttttctacaataaaggctttcgctttatcgctttgcgacgtttcaaaataaggctcatcagatgggccagtgtgagcaagtgctacgattaaatccgcccccgcttttttcacgattggcacatatttttcagccgttttcacaatatcacgagcttccactttgccgtctaaatgggctttatcccaaaccattacttgtggtggaacgaaaccgatataaccgacatttaaagtatgtttcacgccatcttcatcaaccacttcttttttctgaatgaagtatggttggtaaactggctcatcagtacctggtttaacgcatcaatcgcagggttagatttaccctctttataaccgaccgcagcttgataatccgcaatcggattaccttgaattaagtcaccattatcaacaagtacactattttaagcttcttttcgagcttgttcaattaacgttgcggcacgagtaaaaccaaattttgttgttggcgcatctttataatagtcaaaatccgttaaaaaactgtgaatatccgttgtgccaatgacacgtaagaaactttgctatcaccagctgcaaatgcaaagcgatttgcactaatggctaatacagtggtcgcaccaatttgaagaaaacgtcctctgttcatcataacaagtatcctcattgatataaaaaaagggagagtattataggcaataatactctaaaatgccttaatccttttatcaaatctgtgatcgacttcacagaatagataaattaaggctgtataaaaaccgctattctaatttctgaagcggttactttagagggaatatagaacagataaaaactagattatctatgtaattagaaataaataatacatataaatctacttaagatccctatacctcataaaaatccctgcatgataagcagggatcttattagattaaacttttaataggttactcttttgacttccaaattaacggatcaacaccacggcgaataagctctgggtgatcttcaattttgaatacaggctgctctacccctgctttcacttgtttttggtaatcttttaagataacccaaacaattggagcaagtaaaacgatagacactaagttgatcatcgccattgatgccattacggtatcggcaaacgcccaaacaataccgccatcacgcacagcaccgaagtaaacgaaaaataacacgattaaacggaaggctaatacgaaacttggtttgttacggatatagcgaatattgctttctgcataagcatagttaccgataattgaagtgtagcagaataacaataagataaaggctaagaagtgtaagccaaattcaccgatgtggaactctaacgctttttgggttaaagatacgccacgcaatgattcgctaccataatcgttagacattaaaataatgattgcggtacaagtacatacaataatggtatccacaaatacccctaacatttgaattaagccttgacttgcagggtgttttgcatctgacgttgccgctgagtttggtgcagaacccatacccgcttcgtttgagaataaaccacgtttaatccccattaacatcgcttgtgagaataatgaaccaaagataccgccagccattgcagaaaagtcaaaggcactggtaataattttatttaaaacttcaggtactcgctcaatattcatccctaaaatgatcattgccataattaagtagaataacgccatcatcggcacaactttcgctgaaacctgaccgatacgtttaatcccaccgaagataatcgctgcagtcacaatcactaacacaatgcccacataatgcggatcccattcccacgcattacgcgttgcttcaacgatagagtttgcttgaaccgcattgaacgcaaaaccgaaggtaaaaattaaggtaattgcaaaggcaatcgcaagccaaggagcttttaaaccacgcttaatgtaataagctgggccaccacggaacataccgtttggatcacgcactttataaacctgtgccaatgatgattctgcaaatgcactactcatacctattaacgccgtgatccacatccagaacactgcacctggtccgcctaatgcgatagcagtcgcaactccaccgatattacccacgcccacacggcttgccaagcctgttgcaaaggcttggaacggggttaatgactcgccctctgcagcacggccagaccacatttcacggatactacgaggtaataaacgtaattgaactaagccagtggtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactaagccagtggtaatggtaaagaataaaccagcacctaaaagggttaatacagtaatatcccaaagtggaccgtcaatcgtgttcacgatccattttaaaacatcttcaaaaattgaaacgatgctatccatcgaaaagacctcataaaaaagtaaaacaatttcggcattttaacgattttttatcttttgaaaagatttttttaattaaaatgataaaaaaagttaatgattagttatttagcgagctggactggtttaaataacaaattctgtctaattagcaaataatacaagggacaccacgcttggtgtccattgaatatgacataacttaacgcttaaacaaaagattttggcttgtatctaacaaactactgtggaataaggtaaaaccaaaaccgatcaaaagtaatccaatcagcaattttccgaataaaacagaccgcttgtgagcagaaaatgaaagataccaatggctaatatgcaccgctttacggcgagcgaaaagtaccaaacaggcaaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacagccacaatctgcagaatgttgatgatgagcagtaataagcggtgattttggggctattttttgcaaatggcgaatttgaaagccctttggctttgctctcacgctttttaacgcttgataacaccaataaagcccaaacaacatcattacaacaaaactgcctcgctcaacccattttaacgctagattaaaatagctacgagaaagggtaaaaatcaccacaataatcgtcactaacccaatcgccaccaagccttgcactaacgcagacaacaacgtgattttcaccgcttgtggcagtttggtttgttcaaaagagagataacttgttagaataaacttaccgtgacctgggccgacggcgtgaaacacgccatagataaaactcaccgccattaagctcagccctgcctgttgctggttttcgtttagacgatttaacgcccctgaaagggcaaaattaaattccctctgccactcgctgactttaaataagagatagggataagcctgataaatcgcaaaaagagccaccaatccgaccgctatcccagcccaatactttgcctttattgacatacaatactcactttttgcgcaaattgtgcgcctaaagacaagccacgttctgctggcatatcgggggtttcatttttatctaatgtcgatgcatacaaccgcaaagattgatttaccgtcggctcaatcatctcaactttacaaagattttgctctgtgctactgacatcactcgctttttcgtaattcattgctaagtaataacttggctcaaaggtaaaaaaacggaatgactgcccaaggtgaaatggtaaataatacgattatgctgaatttcaacggacgagttatacggtttagctttaaacttaatcggttcattttgctgattataaagctcgctaaaatagtgggtactcaccgcagattcatctaactcacgcaaaattttattcattgcctgttttttatccttactgctgttgatttcatagatcagttcagctgatgtaatctcatcaagtgtccagtacaattcaaaaccttccagcttaccttgttgaattagcactttatttttcatatcaaggaaagagtgtggatgagcaaaaacagaaaaagagagtaacagcgaaatcgtgccgataaaaaaacgcttaagcatttgaaatccttataatgaaatcaattttaaaatcattatatcagacttttataagggctttttgttccgacatgcttcaataaaaaagcgaacagacaaaatctgttcgctcttaaaaattaggctgagtcggtcgataagccgagttctgtcgtggacaatcattcctctaggcgtacattcacacatacgctcgagcaacctacccgaatcccaagcgggcaactcgttggattcctatttggtcttgctacgagtggagtttaccgtgccgtgaaatgttaccactcacgcggtgcgctcttaccgcaccctttcacccttaccagcagaaactggcggtctgctctctgttgcactagtcgtaggctcacgcctcccagacgttatctggcactctgccctgtgtagctcggactttcctctcgtttacttgtcccactaggtcgttcttacgaacggttaagggcttcaataaaccagcgattgtctaaccaactcaggctggcgagtatagcggatttatgaacttttgcaacaaaatgaattgtctcattcctattatcaacgttgattgaatcacttggaatatatgatttatattcaacaattttcaaattaatgcatacaagccaactcttttctttaatgtattatgctaccaagtcttatcctcttgacgagcaatccccttatgtcttaacaacgcatctaacgtaggtttgcgaccacggaagcgttcaaacaagaccatcggctcttctgaaccgccacgggttaagatattatctaggaaagactgcccaacctcacgattaaaaataccttcctcttcaaagcgtgcaaaggcatctgccgataatacttctgcccataagtagctgtaatagcctgcggcatagccccctgcgaagatgtgggagaagctgtgtggggtacgcacgaaagtcggtaattccaccactgcaacctgtgcttttaccgcttttagcgtatctaacacaatattttctttcggctcactcatatgtaaacggaaatcgaataaaccaaattctaactggcgtaacacaaacattgctgcttggaagtttttcgctttcagcaactgggtcaatttctcttttggtagtggctcgcctgtttggtaatgtcctgaaataaaggcaagggcatcttcttcccagcaccagttttcaaggaattgacttggtagctcaactgcgtcccacggcacgccgttaatccctgaaacgtcacccacatcaatttcggtcagcatatggtgaataccatgcccaaactcgtggaacagcgtagtaacttcatcgtgtgtaaacagagctggtttatcgccaatcggtttattgaagttacaggttaagtaggcaacaggtttttgtaatgaaccgtccgctagacgtttttgattgatacaatcgtccatccaagcaccgccacgtttattttcacgggcatatagatccaaatagaatgagccacgcaagcggtcagtttcatcgaaaatattgaaaaaacggacattctcgtgatagctatcaaattctttctgctcctccacccgcataccaaaaatgcgtttcaccagttcaaataaccccgaaagcacacgttcttcagggaaataaaggcgcaactcttcatcgttgatcgcatataaggcttgtttctgtttttcactataaaacgcaatatcccacggctgtaattcgcttacgccatagctctcttttgcaaaggcttttagctcagctaactcttttttgccttgctctttagaacgatttgctaaaccttccaagaaatcaaccacttgcgttgggttttccgccattttggttgcaagggaaagctcggcatagctttcaaaacctagtaatttagctaactctaagcgtaactcaagggtttccgccataagtgcagagttatcccatttacctgcatttggaccttgatctgacgctcgtgtgttataagcttcatacattttctggcgaagctcacggttttcacaataggtcatcacaggcaaatagcttggaaattcaagggtaaagcggtagcctgatttctctttactttgtgctgaaaatttcgccccttcaagtgctgactctggcaaaccttttagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaatatcccaacccattgttgcatcaaggacattgttgctaaattgtgagctaagttcagataaacgagcagaaatttcgccatagcgtttttgtttatctgctggcaatgagatccctgataactcaaaatcacgcaagctgttttcaatcgcttttttctgagcgagcgaataagtggcaaactcagggctatttttcagtttgacatagccttgatacaacccctgatgttgcccaacccaagtgctgtattcggataacatcggcaaacacgcttgataagcttcacgcaattcagagctattttttactgaattgagatgcccaacaggcgaccacgcacgagagagtttatcccctgtgattgcttgcggtaggtagaagttttcccacgttggtgtattaatttgagaaacttgttcaatcgtatcacggcattgttgaattaactgctcaatagcaggcacaacgtgttcaggttgaatttgagagaatttaggtaaacttgtgttgtttaaaagtggatttgacattcgatttcctctttatttgataaaagtgcgacatcttaccattttagcgattattttcattagttgattgtgatttatgggggaagccgttaaaatttcagttatatacaaactgcaaactgcaaaaaattaaacacaaccgaccgcttaggaaaacgcaatgtctttagatttatcggatattcgacaacaaatcattcaaattgaccgcaacttattgaaattattatcggagcgtcatcgacttgcgttcgatgtagtgagaagcaaagagatcacgaaaaagcctctacgagatatcgaacgtgaaaaacaactgttacaagaattggttagttttgctcaagcggaaaattatcaacttgacccacaatatgttacgcaaattttccaacgtatcattgaagactctgtcttaacacagcaacattacttgcaaaataaactgaatcagaatcaagaaaatgccaccattgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttaggtatgcgtggctcttattctcatcttgcttctcgccagtttatgaaaaacagcacggcttctttagtggaactcagttgcgaatctttcgattcagtttttgaaaaagttcagcaagatgaagccgattatggcgtgttgccgttagaaaataccacatcaggttctatcaatgaagtttatgatttgttgcaacatacagacttaacccttgtaggcgaattagcttatcctattaaacactgtgttttaggaacaaacaatgctgattttgcccaagtggataccatttatacccacccacaacctgcacaacaatgtagccaatttattcatagtttagataaagtgcatatcaaatactgtgaaagtagttctcacgctatgcagttagtggctcgtttaaataaaccaaattgcgttgcgttaggtaatgaagatggcgggaaattgtacggtttaagcgtgttaaaaagtggtattgcgaatcaagaaaacaatattactcgctttattgtagtgtctaaaaaaactatcaatgtttcgccacaagtacagaccaaaaccttgttattaatgacgacgactcaacaagcgggtgctttggttgatgcgttgatggtgttcaagcaacacggcattcgtatgattaaacttgaatctcgacctatttatggtaaaccgtgggaagagatgttctatgtggaattagatgccaatattcacaatgaaaatacccaaaatgccttgaaagaacttgaaacagtgacgagtttcttaaaagtattgggttgctatccaagtgaaattattgagccagtccaaatcaacaatataagttaggaaatctcttagatattcctagtatgttacttataatggcagctgccaattaatttcttcgactccgtgagaacgaaggtaatcattggtttttgaaaaatggcgacagcctaaaaagccacgatgtgcagagagcggtgatgggtgaggggctgtgagaacgcaatgacgagagcgatcgataaattgtccttttttctgagcatggcttccccaaagcaaaaataccagattttcacgatgtagattgagttgatggatcaccttatcagtaaaggtttcccaaccgatattggcgtgtgaatgtgcttttccttgctcaacggtgagaaccgtatttaacaatagcaccccttgttttgcccactcaatgagatagccgtgtgatggtatttgaaacccaacatcttgggataattctttgtacatattaaccagcgagggaggcggaacaattcctggttttactgaaaaagataaaccgtgtgcctgattggggccgtgataagggtcttgccctaaaataactaccttcacatctttgaattcagttaaagcaaaagcactaaacacttcattttgaggtgggtaaattacttttccaactaaacgttcttgatgtacatattgcaaaatatgttgaaaatagggttgtgttttttcttccccaatggcatcagtccaactgttcatattctatcctattattaaattgttaaaaattaaaatgaactgttaactcttgtctattttttaagccatcatcagtttttttgataaaaatgcttaaatttttctcgctttttaaaggattaaagttagaatactcaaaattttttgaaactttaaactttttttataatttacccaacatactaggagctaaaaatgatcaaaggtgtacaaatcactgaatctaccaacaaaaacttattaaactctttctggttattagatgaagagaaaaatgaagcacgttgcttagcagctaaaggtgatttccaagaagaccaaatagttgcaatcagcgaattaggtcaagtttcataccgtgaagtcccagttaatgttgcaccaaccattaaagttgaggggggtcagcacttaaacgtaaacgtattacgtcgtgaaacattagaagatgcagtgaaaaaccctgagaaatatccacaattaactatccgtgtttctggttatgcagttcgttttaactcattaacaccagaacaacaacgtgatgttattactcgtactttcactgaaagtttataattacatcttttctcaggccctaccgtaaggtagggctttattgtatctattttgacatagtagcagatatgttttctactatatcattattttaaacccaatttcttctcaagatagtggatattcgttccacccttgcagaagttttcatcagaaagaatctgtttatgaagtgggatattggttttaattccttccacgatcgtttctgacaatgcattttccatacgacgaattgcaatatcacgattttcagcaaaggtaatcaatttaccaatcattgaatcataatgcggtgggactgaatagctagcataaatgtgagaatcccaacgaacacctaatccacctggaacgtgtaaacgggtgattttacccggtgatggtaagaatgtacttgggtcttccgcattaatacggcattcaatcgcgtgaccacgcactttaatatcttcttgtttaactgagattggtaaacctgcagcaacacgaagctgttcttttacaagatcaatacctgtaatcatttctgtgacagggtgttctacttgtaaacgggtgttcatttcaatgaaataaaactcgccattttcaaataaaaattcaaatgtacctgcaccacgatagccgatttcacggcacgcattcgcacaacgttcaccgataaactgacgtaattcaggggtaatgcctggcgctggtgcttcttccaccactttttgatggcgacgttgcatagagcaatcacgctctgccaaataaaccgcattgccgtgtgtatctgcaagcacttggatttcgatatggcgtggattttcaaggtatttttccatataaaccatatcgttattaaaggctgctttcgcttctgctttggtcatcgcaatagattcttccaaatctttttcgtgatgaaccacacgcataccacgaccaccgccgccaccagatgctttaatgatcactggataaccaatcttctgtgcaatttctttatttttggcgacatcattaccgatagggccaccagaaccaggcacacaaggtacgcctgcttttttcatcgcattaattgcagaaactttatcgcccattaaacgaattacatctgctgttggaccaataaagataaagcctgaattttctacttgttctgcgaagtttgcgttttcagataagaaaccataaccagggtgaatcgcatcagcaccagttacttctgcagcggcaataatcgcaggaatatttaagtaactttttgttgatggcgcaggaccgatacatactgtttcatccgcaaggagaacgtgtttcaactcacggtctgccgttgagtgaacagcaaccgtcttaatgccaagttcacggcacgcacgcagaatacgcaatgcaatttcgccacggtttgcaatgacaactttttctaacataagagatacccttaattgaaagcggtctttttcgtgcaattttttgcaaaaatctgaccgcttgtaagaaatggattattcaataatgaagagtttctgatcaaattcaaccgcttcgccgtcgtttacaaggattgctttgattacccctgctttgtctgactcgatacggttcatcattttcattgcttcaacgatacaaagtgtgtcgcctactttcacggttttacccacttcaacaaatggagctgcttctgggcttgggctacgatagaatgttcctaccattggtgaaagaatcgcgtgaccagatacttccgctgttggtgctggcgctgccgcaggtgctgtttgagctgctggtgcaggggttgctgcaggtgctggcgctgcttgtggtgcagcaacatattgtactgccgcaggtgcaactgctggtgctgcacggctaatacgtactgtgccttcttcttcagacacttctaattcagtaatgcctgattcttcaactaactcgataagttttttaattttgcgaatatccataatgagatccgtatttgaatgtaaaaataaacaaactctatgttcaaagaacatagagcaaaattttgcgtagattacctgaaattttattaatttgcgacgaaaatctgataaatttgccgaatttattagcaaatttgccactaatcgtagcagttcagttttctttttttacttcagacaacaaaaaatggatttatttccctctctttagaaattgaatagcataatctaaggcgtaatcgtaaccttttgcccctaatccacaaatcacgccttttgcgacatcacttaaataggaatgatgacggaaaggttcacgggcgtgtacgttggataaatggacttcaacaaaaggaatagcaactgacaataaagcatcacgcaaagcaacgctggtatgagtagacgcaccggggttaatgataatgaaatcggtattttggaatgattgatgaatacggttaataatcggctcttcgccatttgcttgaaaatactctagacaatagcctcttgccttcgctaattgttggaggtggttttcaatatcggctaaggtttgtgaaccataaatatggggctctcgtttccctagcatatttaaattaggtccgtttaataacaagatttttttcattatattatccttacaagcggttaaaaatgagcaagattttgcaatgttatcaaattctaaccctcgccccttgtgggagaggggcagtttttgcttcgtttacaagaaaaaacagggagaggggagagaatttagctacttatgttgtaattacttttatcattcaacattcgaacaacttaatggatataaattcaatttttccatcagcactctatcgccatcttcttctgggttttccgtcgttaataatttatccccataaaagatcgagtttgcgccggccataaaacacaaggcttgcatggcttctggcatattgctacgcccggctgaaaggcgaacataactttttggcatcgtaatacgcgcaacagcaatggttctcacgaattctgtccaatcgagatcttctgcattttcaagtggtgtgcctgccactttaaccaattggttaatcggcacgctctctggttgaggatcaagattggctaagctggcgataagtccggctcgttcagctcttgtttcattcataccaacaataccgccgcaacagatttttaaccctgcggagcgcactttacctaaggtatccattcgatcatcgtgagaacgagtgtgaatgaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgatagcgttccggatcggtatctaaattatgattgtagtaatctaatccggcttcttttaaatcttccgccataccttcttctaacataccgaaagtaccgcaagtctctaaacctagggatttgaccgctttaatgatggcggagaccgtctcaatatctttaggtttaggacctcgccacgctgctcccatacaaaaacggcttgctcctcgagccttggcaatttgggctttctcaacaatatagttcacatcaagcatactttgcttttcaacacccgtgtcatagcgggcagattgtgggcaatactcacaatcttcagcgcaaccgcccgttttaatggaaagtagcgtagaaagttgaatggcatttggatcaaaatgttgtcgatgaatttctgccgcccgaaaaactaagtccataaaaggcaaatcaaaaagttcttcaacttggcatttacgccaatattgtgccgttggatgcggcgtgagctcatttttggcttttaaacgtagcgaataggtcgtcatacaagatctccaaaaaagaggcacaagccgttgcttgtgccattcagtgcgaaaattactcttcgatagaacgtaataagtcgttaagacccactttacctaatgttttcgcatccacttttttcacgatcactgcacagtataagctgtgtgaaccatcttttgcaggaagactacctgaaaccaccacagaaccggcaggaacacgaccgtaatggatttcgcctgtttcacgatcatagattttggttgattgaccgataaacacgcccattgagatcacacagccatcttcaacaatcacaccttctacgatttcagaacgtgcgccaataaaacagttatcaccaataatcgttgggttagcttgtaacggctctaacacaccgccgatacctacgccacctgataaatgcacgtttttaccgatttgcgcacaagaacccaccgttacccaagtatccaccattgtaccttcgccaacataagcaccgatgttcacaaatgatggcattaacaccacgtttttctcgatgtgtgaaccttgacgcacaacggcacctggaacagcacggataccatctgctttgaactgctcttcgctatattcaccgtatttggtcggcactttgtcgtagtatttagtttctgcaccatcaatgatttcgttttcgttgatacggaatgaaagtaaaaccgcttttttcacccattgattaacaacccattcaccatcaattttttctgcaacacgcagtgaaccattatctaatcctttaatcacttcttcgacagccgcacgagtttgtgcatcaacagtttttggagtaatttcagcacgacgctcgaacgccgcttcaataattgcttgtaatgacatttgcatttccttcttgtaagttaaataaaaacggcgaacgttttaacatataagcgatgggattgctactaaatttcacaaaataatgtaatagatacatataagcggcatgattctacggattttttacaaatccagattttctctttgactagttacttcaaaatctgtaatattcgcaccctatgcaaaaggtaaaactacccctaactattgacccatataaagacgctcagcgtcgaatggactacgaaggctacatttctgcgaacctacttagccgtttgggtgaatctgttggtcaaatgctgggcgatgcacaagttactttatcgttatatgttgatccgcaaaaactcacagtggttaaaggcactgcgaaagttgatgtggagctagactgtcaacgttgtagtaacccatttacgcaaacactcgactgcacattttgtttcagtccagtgtctaatatggatcaggcggacaatttgcccgagatttatgaaccaattgaagttgattcttttggtgagataaatttgctagatatgatagaagacgaattcattctgtcattacccctagtgccgatgcataccgatgaacactgtgaagtgtccgaaagcgaattagtttttggcgaattaccagaagaactggcaaagaaaccaaatcctttcgcaatattagctaatttaaagaaaaactagatctagtaggagtatagccaatggctgttcaacaaaataagaaatctcgttcacgtcgtgatatgcgtcgttcacacgatgcattagccacagctgcagtatctgtagatgcgcgtggcgaaacccacttacgtcaccacgttaccgctgacggttattaccgtggtcgtaaaatcaaataatcaattggatctcgtagaggtttaaattgactcatctaactctcgcgttagatgcgatgggcggggactttggtccccgtattactatccctgcattatcacttgcgttggctcaacatccaatactcagttgcatcttgttcggcgaccaagctgaaatatccccctatctcaataaactttctcccgatattcaacaacgtatcgaattagtccatacaacaaaagtgatcgaagcagacttgccttttgtgcaagcgattcgtcaaagtaaaggcagttcaatgcgtttagcgattgaagcggtagaaaatggaaatgctcaaggctgtgtaagtggcggaaatacaggtgtactgatgggactagcaaaacaattgattgaacccttgccaaacattgatcgtcccgcattaacatctttgattccaacaattaacggcaactcaagtgtgatgttagatcttggtgcaaacgttgaagcagatagtgaactattgcttcagtttgcggaaatgggcaatgtgtttgcagaagtgatgttggatttggtctatccacgtttagcgttgctgaatattggaacagaagagcataaaggaacacagcaaattcgagatgctcaccagcaattaaaacaatgtaatcatctaaattacattggcttcttagaaggggataaattaatgaatcatcttgctgatgtgattgtctgcgatggatttagcggtaatgttgcacttaaaacacttgaaggtgcggcaaaaaatatcctttcactctttaaaaaaacaacggaagattcacatctttgtcgcaataccaaacgttatttactacgtttaatcttttatcgttactataaaaagctacaacagatcaaccctgatcgccataacggtgccacactgctcggcttatcgtccgtggttgtaaaaagccatggtggggcaagtgagcgagcgtttttctatgcaattgattacgccaaacaacaaattaaaaataacatccctacaaaaatctcccaaagacttattctaaacaattaagctcgctgtatcacaggtaaagttttattcagaaaaaacttttcttttttttaaaaatcgctactatacgccgtcctcaaatataacccaacatttgaggcgttgtttccaacctatccaatcctagggagcaatagggtaaaaacaaaaaagctgaaacgctttttttaataagtagcgagtcaaatgccccaaggcatcttatctttcaggataagaaagcttaggcttcccgcaaggcacccgacttatttttttaacctcttatagaaggtctattttcaaatgacaacaactcctgtaaatccgatcaatcaagcaactaacgaatattacttaactcgtcaaaacgaaatggaatcgaatgttcgtagttatcctcgtaaattaccgcttgcaattgcaaaagcacaaggttgctgggtcactgacgttgaaggtaacgaatatttagattgcttggctggtgcaggtactttagcactcggacataatcacccagccgttattcaggctattcaagatgtattagcaagtggtttaccgcttcatacccttgatttaactacgccgttaaaagatgcttttaccgaagaactactctctttcttcccgaaaggtgaataccgtttacaattctgtagcccttctggtgcggacggcacagaagcagcaattaaattagcgaaaacctatacaggtcgcggtaatgtaattgcattctcaggtggctaccacggtatgacccacggttcgctctcaatgacaggtaaccttaatgcgaaaaatgccgtgcaaaacttaatggcaggcgtacagtttatgccatatccgcacgaataccgttgcccgttaggtatcggtggcgaagcaggtgttgatgctttaacttactattttgagaactttatcgaagatgttgaaagcggtatggtaaaaccagcagccgttattcttgaagcaattcaaggtgaaggcggtgtagtgactgcaccagtgaaatggttgcaaaaaatccgtgaagtaacgaaaaaacacgggattgtgttgattttagatgaagtccaagcagggttctgtcgttcaggtaaaatgtttgcctttgaacacgcaggcattgagccagatgttgttgtgatgtcaaaagctgtaggtggtagcttaccgcttgctgtacttgcgatcaaaaaagagtttgacgcttggcaaccagcaggacacacaggtacattccgtggtaaccaattagcaatggcaacaggttcaaagatcaatggaaactgccgtacaagcggtgagtaactggctacaaaatgaaaaaatgtacactggcggtagcattaaacagctacgctcagaaattgcctttaacccgccaaaagaaggcttaggcgttgctaaatccctagatcgcttaattgaattattcctcaacaaaagtttaaaagtacaccacccacactctttggctcatttacactgtccaacaatggtcaccagccaaatcgccgaagtattaatcaatgccaccaatcaatcaatggactcttgggatcaaagcccagcaggttcattaatggaagtgcaactcatcgagtggttgcgtgaaaaagtaggctacgacaaaggacaagcgggtgttttcacttctggtggtacgcaatctaacctaatgggcgtattacttgctcgtgatgcgtgcattgcaaaacactggaaaaatgccgacggtacagaatggtcagtgcaacgtaacggtattccgcctgatgcaatgcaaaaagtaaaagtggtttgctcggaaaatgcacacttctctgtgcaaaaaaatatggcaatgatgggaatgggattccaatctgttgtaactgtaccgtgcaatgaaaatgcccaaatggacaccaatgcgttggaagcaaccttagccaaactttatttagaaggcaaagttgtggcttgcgttgtggcaacagcaggcacaacggacgcaggggcgatcgatccactcaaagccattcgtgcgattaccaacaaattcggtgtttggttacacgttgatgcggcgtggggcggtgcattactgctatccaatgaatatcgccacttcctagacggtatcgagctcaccgactcaatcacccttgatttccacaaacacttcttccaaagtatctcttgtggagcgtttttattaaaagatgaaaacgaataccgctacatcgactacaaagcagattatctcaactcagagtatgacgaagaacacggcgtaccaaacttagtggcaaaatcactacaaaccacccgtcgttttgacgcattaaaattatggtttacggtggaagcccttggtgaaaatctttacggctcaatgattgaccacggcgtgaaattaactcgtgccgttgcagactatatcaaagcgaccgacggcttagaactattagttgaacctcaattcgcttccgtgttgttccgtgttgtaccgcaaaactacccagcagagtttgttgataccttgaaccagaacgttgcagatgaactctttgcccgtggcgaagcgaatatcggcgtaaccaaagtgaacaacatacaatcgctaaaaatgaccaccttaagtccaattgcgaccttagaaaacgttcaggctttattagctcaagtattgagtgaagcagagcgtatcaaagatgcgattgcgaaagctgaatatacaccagcgattgattaaacataaagagtttctaggatgatgaataaaaattaatttctacgctataaaacgaataagaaatcatcaataactcttttatttagttcatttttagttaaattcatgctaaccctataaaatagataacaccctattttatagggtaattttttatttatccctaagatttaaacaattagtaagctgataggaaaaagatgacaaacagcagattgcgtactaccatatagcccaattttattggataacgagttcaaatgatgcaccgtagatttcaaaccattgcgattgtcggcaaacctcgtcacgatatagctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaacgcatttagctgtgtataactggctaaaagatcgtaaatataatgtgttagtcgaagaaaaaattgccactcaactcaatttagctaacccgatgaacattgcagaaattggaaaatgggcggatttagtaattgtgattggtggtgatggtaatatgctgggtatggctcggcaattagcgaaatatcgtgtaccactgattggcattaaccgtggaaatcttggttttttaacagatattgcccctcaaacagcctttgagcaactgcatagttgccttgagcgtggcgagtttatgattgaagaacgtttcttacttgatgcgaaaattgagcaaaatggtaagatcattgaagcaaataatgccctcaatgaagttgtcgttcactctagccaaatcgctcgtactattgattttgaagtgagtattgatggcaaatttgctttttcgcaacgttccgacgggttaattattggaacacctacaggttcaaccgcctattcgctttccgccggtggcccaatcttaacccctaatttaaatgcgattgctcttgttccgatgaacccacacagcctttcttctcgtcctttggttgtcgatggcgatagtgttatttcaatgcgttttgctgagtacaatcagtcaaatttagtgattagctgtgatagccaacgtttactgccgtttagccctgatgaacgtattcttgtgcaaaaaagcccggataagttgcgtctattgcatttaaaagattacaactactttaatgttttaggttcaaaattgggctggttgagtaagttattttgacataatatgtttcaaaaaattggcatagcgactattttgtctactatgccccaatattgctgggaataatcccctaaatgatttcttaaaattttaatttttgtacgactatcgtataacatcagaagttgcatttagcgcctgacgctgtgcttcaaacaactgctcaatccctttctgtgctaaatcaaggagttgcaataattccatatggctgaacggttcaccttcggcagtgccttgtacttccactaaacgaccgtcttcaaccatcactacattcatatcggtttctgcgttagagtcttccacatattccaaatcacagaccgcttgcccatcgacaatccctacagaaattgccgctactaagcctttcatcggattttctttcaataagccatcggcgatcaatttgttaatcgcatcgtgtaacgcaacgcaagcccctgtgatagacgctgtgcgtgtaccgccgtcggcttgtatcacatcacaatctaccgtaattgtacgctcacctaaggctttcaaatcaacgactgcacgcaaagagcgagcgattaaacgctgaatttccattgtacgaccgccttgtttgcctttcgccgcttcacgttgggttcggctatgggttgctcttggcaacataccgtattcggctgtcacccaaccttgttgttgccctttgagaaaacgtggtacagtttcttcgacagtggcattacacagcactttggtttcaccaaattccaccaacacagacccttcggcatagcgagtatagttacgagtgatttttacaggacgagtttgatcaacaggacgattatttggacgcatatttattccctttctctaaaaaatttcccctattctagcagaataccaagtacaatatgccaaattttgtaacaaagagaaaagagtacaatgatttacagtatgaccgctttcgcccaccttgagcttaaaaaagagtggggtaacgccgtatgggaaatccgttcggttaatcaacgttttttagaaacttatttccgtctgcctgaagcctttcgcaatttggaaatgaccttgcgtgaacgtctgcgtacgacactaacccgtggtaaagtagagtgtagtttacgcattgaattaaacgctaatcaaaacaatggcttagctttaaatcaagagtatgccaaacaggtgataagttcattacaatggctaaaagaaacggctcaagaaggcgaaattaacttggtggatattctgcgtttccctggggttgtcgataaccaaaatcaagatctcgaccagatcagccaagatttattatacggttttgagcagatccttacagaatttatcgcaatgcgtggacgtgaaggggcgaatttacaagccttaattcaacaacgtttagacgctattgccacagaagcgacaaaagtacaggctcaaatgccgagcgttttacagtggcaaaaagaccgcttgcaacagcgttttgatgaactgaacttgcaacttgatccacaacgtttagagcaagaaatggtactactggctcaaaaagtcgatgtggcggaagagttagaccgattacagctacacgtcaaagaaaccacgtctattttgaaaaaaggcggtgcagttggacgtaaattagactttatgatgcaagagctaaatcgtgaagcgaatacgctggcatcaaaatcgattaacgctgatgtcactaattctgccgttgagttgaaagtgttaattgaacagatgcgtgagcaaattcagaatttggagtagtcaatgagtcagaccttaaccccatttcatacctttcatttgcctgcaaaagcatcggtcattatcgagttcaacagtattgaacaactattaaccgaatggcaaaaagctgatcacgcacaacaaccgattttattgttagggcaaggctctaatgtgctgtttttagatgattttgacggcacagtattagtcaataagctcaaagggatcgagcatcgtcaagatgagcattttcattatttacaggttgcaggtggtgaaaattggcacgagttagtgcaatggacattgcaacaaggaattggcgggcttgaaaatctggcgttaattcctggtgtcgctggttctgcaccgattcaaaatatcggggcttacggggtagaatttgagcgtgtttgcgattgtgtcgatgtactaaatctcaaaacgggtgagctgttccatttaacgaaaaacgagtgtgagtttggctatcgagaaagtgtattcaagcatcaatatcgtgagcattatgcgattgtggctgtcggtttgaagttggcaaaggtgtggcaacctgttttaaattacggttctttggcacaatttgatccaaacacagtaacgccacagcaagtgtttgatgaagtctgtaccgtacgccgagcgaaattaccaaatcctgatgagtttggtaatgcgggtagtttctttaaaaatcccgtagtggaatttgcaaaatttcagcagattcagaccgcttacccgaatattccacactatccacaagcggatggttcagtcaaattacctgcaggctggttaattgaccaagcaaatttaaaaggtttccaaattggcggagcggcagttcatacccagcaagcactggtgctgattaataaagagaatgccactggggctgatgttgtggcattagcaaaagaagtccgtcgtcaagtccgtgaaaaatttggcgtggaattacacccagaagtacgttttatgggacgacagggcgaagtggatagtgaatttgtgacaaggtaattggcaatgggatttgatcaacatttaattacatcggcattaacgcaaggacaagctcttgtatttaaagagattgactccaccaacgaatacctactgactcactataaaaccttgccatcaggctcactttgtgttgcagagtcccaaacggcggggcgtggcagacgtggacggcagtggtattcacctgaaagtcaaaacgtttatttttcaatgttatggcactatccttcattggatattccacagctctcatcactaagtttagtggtatcagtattaattgccgagaccttccaaacactgaacgtaccgcatattcaaattaaatggcccaatgatatttactatcaaggtaaaaaaatggggggcattctaattgagagccgtgtcgataaaacgggaatttaccttgtgattggcatcggcttgaatttaggaatgaacactgtcgataaaaatgtggtaacgcaggcttggagcgatctctcagaacatcagatagatcgttcccaactggttgctgagctagctaaacgtttacaaaatgccctagtgacttatccacaaaccacctttgaaccctacacagaacgttggcaacagtttgatattttccgtcatcaagcggttagattaatcactgaaaatgaagaaattcatgggatctcccttggaattaatgaagaaggggaattgattttacagcaaggagaaattatccgccgttttgcgacaggtgaaatgtcattgagaggaaactaatcgtccctatctcaattcatattttagggatgccgtaatcaaaagagttagtgaaagttagaaaaacagaaccaactcttttgtccactatgcttttttaggctgtaaaaatagttatatactttctagttgcttgcttcgttgaaaaatgaattgaattaacgtattatcaacatccatcactacttttcccttaaatacatgaaagcactattcatcttactcggttttatctcaatgatattaggtttaatcggtattattgtacctggattaccaaccactccgtttttgcttttagcattatattgctttggcaaaggttctaaacgactaaaacagtggtttttatctacctctatctattccaaatatctcaagtctttcgatcaaacacgagcaatgacacttaaacagaaaatcagtattttggcgttttctgtgccattctgtatttttgctttctttgtaatccctcacatcatcggcaaactgatcttaattgctgtgattatctttcaatattattacttcatctttaagattaagactttagaaaaataggctctcaaggtaaaataacaagctgtctaaatttgcaaaaagagaaagaaaatgaccgcttgtttaagcaaagaaatcttaaaaattggcttagtttccgtgtctgaccgagcttctgccggtgtttatgccgatcaaggcattcctgaattacaggcttggttacaaactgccattaccacaccttttgagcttgaaactcgcctaatccctgatgaacaagcacttattgagcaaacattgattgaattagtcgataaccacgcttgccatttagtcctaaccacaggcggtacaggccctgctaaacgtgatgttacacccgatgcgaccttagctgttgcccatcgagaaatgcctggctttggcgaacagatgcgacaagtgagcctacattttgtaccaaccgccattctctctcgtcaagtgggggcaattcgacatagctcactgattttaaacctaccaggacagccaaaagcaattaaagaaactttggaaggggtgaaagatcaagatggaaaagtgcttgttcgtggtgttttcagtgcagttccctactgtttacaacttttaagcgacatttatattgaaacttaccctgaaatttgtgagagttttagaccgaaatcagcgagaagataggataacttatgaaaaaaattgaagccattattaaaccattcaaattagatgatgtccgtgaagcattgacggacgtgggcattacgggaatgacggttactgaagtgaaaggctttggtcgtcaaaaggggcatacggagctttatcgtggggcagaatatgcgattgattttctgccgaaagtaaaattagaaattattgtggctgatgagcaagttgatgaatgtattgaagcgatcattgatacggcacaaacaggcaaaatcggcgatggtaagattttcgtgtatgatgtagaacgtgttattcgtattcgtacgggtgaagagaacgaagaagcaatttaaggaataaaatgaaaaaaacaggtttatcgtggttgtggttaagtgtcgtggtattaatcacagatttattgagcaaatacattgtggtacaacgctttgagctttatgaaagcgtgaatgttctgccgatctttaatcttacgtatgtgagaaactatggggcggcgtttagcttcttagcggatcactcaggctggcaaaaatatttctttttaggtttagctattgtcatttctattgcattgattgtaatgctgtttaaaaataaagcagaacttaaactgcaaaatgcggcttatgctttgattattggtggggcaatcggcaatgcggttgatcgtgcttataatggctatgtggttgattttttagatttttattgggacatttatcattatcctgtatttaacattgccgatattggtattgtggtgggggcaggattgctgattttagaatccattttagaacatcgtaaaagtaaaaagagtaattaaatgaacattattttagcgaatccaagagggttctgtgcaggtgtagatcgtgctatttcaattgtagagcttgcacttgaaattcacggcgcaccgatttatgtgcgtcacgaagtggtacataatcgctttgtggtggacggattaaaagccaaaggggcgatatttgttgaagagcttgatgaagtaccagacggtgctattgtgattttctctgctcacggcgtttctcaatccgttcgccacgaagctaaacgtcgtgagttgaaagtgtttgacgcaacctgcccgcttgtaaccaaagtccatatgcaagtggctagagcgagcaaaaaaggcacaaaagcgattttaatcggacacgaaggacaccctgaagtcgtcggcacaatggggcaatatgataatgagaaagggggtattttccttgtagaagatgtggaagatattgctaaacttggcttaaaagaagatgaggatctgacttttatgacccaaactactttatctatcgacgataccagcgatgtgattgaagccttaaaacagaaataccctgcaattcaaggtccgcgtaaaaatgatatttgctatgccactacgaaccgtcagcaagcggtgagagaattggcgaaattagcacagttagtgctagtagtggggtctaaaaactcgtccaactcaaatcgtttagccgagttggcttctcgaatgggaacaccgtcacagttaattgatgggccgcaggacattgatccgaactggctacaaggggtaacaactatcggtattactgcaggtgcatctgcccctgaaatattggtgcagtcagtggttgaacacttaaaaacattgggtgttaccaaagttgaagaactggaaggttgtgaagaaaataccgtatttgaagtgccaagagagctacgcattacggaggtaaactgatgaatcgttttagaattgaatgggaatgccgtcgaggtatgcgtgaattagataaaatgattatgccgttttatcaagaacattttgatagtttaaccgctgaacaacagcgcactttcgtggaaatgcttcgctataccgatccagagctattccgctggtttatgaatcaagacacaccgccaacagaggcattgcaagagatggtgagattgattcaatcgaaattggtctattgagtaatgatatgtaggtaaagtatttagcatgttagataaaatggttgtttataatccctgtttgtgtgtgggaaaacccaaaagaactatagaaatattttctttggagctaacgttgatcagcccctattattaagacttatatcattatctaaatgaaaaaagaaaaatccgaatttcccttggcacaatctcgtgtggatgccccttttgccaaaggcgtgttggcgtggtatcagcaatacgggcgtaaacatctgccgtggcaacaaaataaaaccttgtatggcgtttggctatctgaagtgatgttacagcagactcaagtggcaacggttattccctattttgagcgttttattcaacgttttcccactattattgatttagcgaatgcacccattgatgaagtgttgcatttatggacggggttaggctattacgcaagagcaaggaatttgcataaggctgcacaacaaattagagatgaatttggcggtcaatttccgacagattttgctgatgtgtttgcactttcaggtgtcggcagaagtacggctggggcggtactctcttcggtatttgatgcaccttacccgattttagatggcaatgttaagcgtgtgctgtctcgttattttgcggttgaaggttggtcgggcgaaaaaacggttgaaaataaattgtgggatctgaccgctcgtgttacaccaacttcgcaagtggcggattttaatcaggcgatgatggatttaggggcgatgatttgcacacgatctaagccgaaatgtttcctttgtccgttagaaaagggctgtcaggcaaatgctcaacaggcttgggcggattttccagccaaaaaaccgcaaaaggcgttgcctgaaaaacagagctactttttgattttaaaacaggggacaaaagtcttattggaaaaacgtgaagcaaaaggactttggggcggactttatgtctttccgcaatttgagcatttagatgatctcaagcggtcagtttcaggcagaaatgtgcaatttacccaattaattgcctttcggcatacttttagccatttccatttggatatttatcctattttggcggaacttagtttacaaaaaaatgccgaagtcctaccgcttggggtggcagaaaatcagggaaattatcatttgcgtgtatcttcaacagcggattattggtatgatttaactcaacctagcgaagtgggtttagcaaccccgataaaacgcattttagacgaattaactttgacattaggacagaaaaatggcgcgtaatgtattttgtgcatatttgaaacaagaagcagaaggtttagattttcaactttatcctggggaattaggtaaacgtatttttgattcaatcagtaaacaagcgtgggcagagtggatcaaaaagcagacaatgttagtcaatgagaagaaactcaatatgatgaaccctgaacatcgtcagcttctggaaacagaaatggtgaattttttgtttgaaggaaaagaagtccatattgaaggttatgtgcctgtagagtcaaaatagagataacctaatgaacaaatataaaaaattcctgccgttattggtactgatcccttttttagcatcttgtggaagtgatacgccgacgagaaaaggttctaaaaagcctcgccctgattattctaaaaataccaatggtttagatattttgatggggcaattttcacgtaatatcgatcaaatttggggcgttaatgaactgctccaagcaagccagaaagactatgtaaaatatacggacaaatattacacccgtagccatattagttttgaagatggtcaaattaccattgaaactttggcggatcacaaccgcttgcgtaattcgattattcacacattattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggatcaatatgggcgttctgtaaccaatgtggcggttgctaatgattttgcaacttacctattgcaaaataaattaaaaacacgccgcttgaaaaatggacataccgttacttatgtcacgattccaatgattgcaaaccacgttgaagttcgtgcaagacgatatttgccattggttcgtcaaatgtcaaaacgctatggcattgatatgagcttaattctgggtattatggaagttgaatcagcatttaacccttatgcagtaagttatgcgaatgcgattggtttaatgcaagttgtacctcgtacagctggacgggatatttttgcgcgtaaaggttttggtggccagcctaatcgtgattatctttataacccaagtcagaatattgatgctggtacaatgttcttaacgattttgcgtgatgagtatctagaaggaataacggatcctacatcaaaacgttacgcaatgatttcagcatacaatagtggggctggtgcagtactgagagtgtttgataatgataaattaatggcgattgagcgaattaataaattagatccgtcagcaatttatcgaattttaaccaccgctcatccatcttcacaagcaagaaactatttggttaaggtaaataaagcccaacaaaaataccgtaacgtgagataacacgttgttttttaaacaaattgaataaaaagcgatccgttaaacagatttttttatttttttgaaaaaaacgtttgacgagaggggcggaaatcagcataatgcaccccgtaacgacgagatgcctcgatagctcagtcggtagagcaggggattgaaaatccccgtgtcggtggttcgattccgcctcgaggcaccatttatgttacaactcttttcctccttagttcagtcggtagaacggtggactgttaatccatatgtcgcaggttcgagtcccgcaggaggagccatatttttagccccgatgagaaatcatcggggtttttctttttctctatatatctaggcatagtagacaaaatggttgctaaaaaagtgacttaaagccttatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtcctctttttaaataattgtctgtcttctttcacaaagaaattacgtctgatagatatttagattgattacacaagtaaaacaaacctataaacaattagcagaaaagtatcaatgtttcattagagctactcaacattattttgcataaaaagaacagtagataccataatgttaaattttccccatccgtctttcgggcccttcctcccgtttgtgggggaaggggttaatgagtaataaactaaggttcgatgaaagtacgcaggaagtttggtagagagggaactatctctccaacgccatcgccaacaaagtaatcgggtgtaggcaggttaagttggtggacatatcaatttgccatttacaggtttcgcactccgaaacgacataatcaaaaccgccgttgttgatgtgttggaataacggattgccgatggcttgtgaggtttcgtagttttccgctttgaagccgtaaatccctgcaataccacaacattgtgatggtaacatcacaatttcaatctctgggatatgttttaatacatcaagggtgtaaggcgcccaacctgctttatcaacgtgacaagcggtgtgataggcaatgcgtaatggcatctgtttgaattttggttttttgccttgattaaacagttcatagagatatttagtgacgatatgaacgtgtggacggactttggcgttgttcattcctaaaacgtgatgatattcgtcacgcaaattcatcgtacagcttgatgatgtccctactacgtcaagctctcggttcatcaccactttttcaagttcagcaaggttgaattttgctnnnnnnttcgctctttctgggaagccatttacagccaatggcaaaccacagcacttctctttttcaagtagcattacgccgatatccattgcgttaaacacatcaatcaactctttaccaagttgtggattgttgtagttcacataacagccgtgatagtaagccactttttcacgataaagggcttggcgttcttgctcttttttcatataccagttacggaatgaaccaaaagcgtattttggcaacgagcgatgacggctcactttgatggttttttcaagcaagaatttggttgcttttagaccagtaatggtattcacaatcggtgctagaggggtattcattttacccatcagatcggtattacttaaaatcgcatcacgcagtttgtgcattagcggtttgttttggcgatctaaatgacggtttctcgctcgcacaataatgtcaccaattttgacatcagacggacaagcgacttcacaacgtttgcagttggtgcagtatttgagtgcttcatcataaagttcagagctttttaagcgtaaacgctcaccatctggacctgattgtttcggacctggatacatcgggttattacgcgaaacagggcaaaccgccgtacaagcggtacatttaatgcaactttcaaaggactcatcaaaaccgtgatgaacaacggcagaatgggtattttgttgagcttgttcgattaaacgttgaatgttgttcatattatgcccccacaatttcttctgcaacggcaagtgccgttaccactgccacacctgagccacagcctaattcaaggctgttaaaaccgccaatgacgttgccagctgcatataaattcgccataaattgcccatctttgcgaagttggcatttttcgttgatcgctacccctgccgattgatacggctgtggcgatgaaaagcgattagccgtccacgacaagcggtcggtttcattgaaatctttgcaaccaacaatatcggcttggaatactggttcaaaaatgcgatcaaagtctgcttttaagccgttgctgaaatagcttcctgtggcgagtacaaaatgttctgcactgatcccattgtcttggtgaagctgggtataaatccgttgtactttgccattttcaatatcggcttttaatgctctgtcgccgcttaacatcaaaccgcccaagcgttcaaaacggtggcgaagttgtttatgttggcgaataccgagcaatgatggcggtaaggttggtaattcaaaaatcgttgcttccaccgcttgttgtaactggttgaagaaactttgatcgtccaagccaaaacaagctggtaagaagatcgcttctgcccctttggttgccgttttgatttctgccacaagatcacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctgccacaagatcacggaaagccaatttgtgttctaacacttgagcgatattcacactacggaactcacgggcattgttacgcagttggtcaagctctggaatattgagatagccagtgcttaattcgcagtgggtaaattgtggattttgttttaggttatcggctaacagttgtggctggaagtcgtgatagccttcgatccccaatatcgcaattgttttataggggaaaggttcgctacctttgactgttggcacgctatttggcgataaccacgctccacgcaagccacctaaaggcgttactcgtaggtgattttgtgcggtagatccgaccaaatcgagcttgagcgatgtggcaagttgttcaaattgtgtcgctttggcaaggactttctctttgccaagtaagctgtaagggtgttgtggcaactgttttgcgaaagttgcataggatttgtaaaaatcagcgacaaactcaccgcttggcaaacggctgagtaaatccattgaacccgatgagaaatcaatcgctgcttgaccattgttgataatcacacaacgtttaccctgttcttgtagggcaaccccacaggttaagcctgcaagaccgccaccgataatgactacatcaaaattcattgctatctgtcccctgttgagcttgctctgcaagcggttgcacatcatttagacctaataaactgtaatagatccaactggtaaaatcggcttctcgaatggcatcgccccacgcaatcggctcaatcccacgccagcgttcttccataaaagaagccagttgggtggtggattgtcgtggtgttgccacttcaaaacgggtcatcaaccctgcggcacggcaggcacagagttctgcttggcaggttcccataccaacgcgggtacggcgacgtagatcgacaagattattgacacttaactcgtccactgcatagcgaacttcccctgtggtgaccgcttcacactcacaaacaagagagcggtcaagacgttctttatccaacaggcgagtagcacgagagccatgacgataaactgcagaatagcgaatggtacttggcagtgaaatgactttgctgttggtttccgctcggctttcacttgaaccaggtaaggctttttctgcagtaacacagcggtcggttttgtttaattttttgcaaacgagatccgttgcccactcagccattaagcgataggtcattaacttaccgcctgtgatggtaataaagccttctaagccatcacgctcttggtgatcgagcaagacgataccacggctgacattacgtcctgatggatcatcatcggtagccactaacgggcgaacccctgcgtaagcacgcaatacacgggtatgtcttaaacttggtgcaagtttttcgccttctctaaagagaatatcgacttcttcaggggtgacgatcatattgtcgatttgatcgtaaggaatacggcttgatgttgttccgataacgctgatagtgtcgcctggaacaagaatatccgcatcggcaggcttacggcaacggttgatcaccattttgttgatacggtgtcccatcaccagcaatgcgcctttggcagggaacattctgattttcaaatcggcatactcagcaatgccttgtccccaaataccgccagcattcacaaccacaggggcaaagaattgacgttccactctgtttttatggtcgtaaacgttcacgccaatcactttaccaccttcacgaattaaccctttcacttcgcaataggtaaagactttcgcaccattctctgtggcatctaacatatttgatgctgtgaggcgaaatggatcaatggaaccatcaggcacaaccactgcaccgacaagggctggatttaccgagggctccatttgcatcgcaagttttggatcgatagcaaccgcttcaatgcctgactccgtacaggcttgaataaaggttttttgataggcgagctcatcttcaggcaaagtaataaacaacccttccgtttcatcaatacagtgacgagcaatccgacgtaagattttattttcttcaatgcactccgttgcagactcacgatcatttaccgcatatcttgctccactctgcatcagcagtggttggttgggcagcagagtactacggctgggacggtggcttctatgtaatgatcgcaggtggcgtattagcagtattgttaatgttcatcacaatgcttgaagaaggcaaacataaagcgaaattagaagatagctatggtaaataattaatgattaaaaggaagacattttggtcttccttttttatatctacaaaaagaggaaaacagtatgaaactcacaaaatttgcattaggtttagtcgcaacagcagtattagcaggttgctcaacatcaacctcagttgcaacacagtcagataaactgattatcgcacaccgtggtgctagtggttatttaccagaacataccttagaaagtaaagctctcgcatttggacaacaagcggattatttagagtaagatcttgcaatgaccgaaaacttcaaagtagaagatggtaaacaagttcaagtctatccaaaccgcttcccaatgtggaaatctgatttcaaaattcacacctttgaagacgaaattgaatttatccaaggtttagaaaaatccacaggtaaaaaaatcggcatctaccctgaaatcaaagccccttggttacaccaccaagaaggtaaagatattgcactggaaactttaaaagtgttgaaaaaatacggttatgaccaaaaatcagaccttgtttatctacaaacctttgacttcaacgagttaaaacgtatcaaaaccgaattgttaccaaaacttggtatggacgtaaaacttgtacaattagtggcttacactgactggcacgaaacggaagaaaaagacaaatcaggtaaatgggtaaattacaactacgactggatgtttaaaccaggtgcgatggcagaagtagcgaaatacgcagacggtgttggaccaggttggtatatgnnnnnnnnnnnnnnnnnnnnnnnnnnnggcaacattgtttacactccattagttaaagagttagcccaatataagatggaacttcacccgtacacagtacgcaaagacgcactacctgagttcttcaccaacattgatgaaatgtatgatgccctactcaacaaagctggtgcaacaggtgtatttactgacttccctgatactggggtggagtttttaaaaaaaggtaaataaaaacgggttagactataaattttttaatagacctcactatctatggatgtagtagtgaggttgattagattattttactctcaacttcgccaacacggcttttagttgtttatccaacggtgctgtcacgaccatttcttcgcccgttttagggtgaacaaatcgaatagaatgggcgtgtaaaaataggcggtttagccccgcttgttgcattttttggtcaaattcacggtcgccgtatttatcatcaagggcaattgggtgtcctgcgtattgagtatgcacacgaatttggtgcgttctgcctgttaccggcgaagccttaactaaagtcgctgtcggataacgttcttcaattacaaatcgggtttcagacggtttgccttcttcgctaactcgcacaatgcgttctccactggctaattcgtttttcaatagcggtgctttaatcactttaacgtgcgattgccactgcccacgcacgagtgcgagataatctttctgtactactttttcacgcaactgttcgtgtaaactacgcaatgcggaacgttttttcgctactaacaacagccccgatgtatctcggtcgatacggtgaactagctctaaaaaacgggcttgtgggcgtaacgctcgtaaggcttcaatcacaccgaagctcaaaccgctaccaccgtggacggcaatgcctgacggtttgttaatcactaacatcacttcatcttcataaagaatttgatgttcaagctctgcaactttgttgagtttggtcgaaatcggtgcttcatttttttctgccacacgcacaggcggaactcgcacaatatcgtccgcttgcaacttatattcgggtttaatccgccctttgtttactctcacttcgcctttacgcacaatacggtaaatcaggctttttggcacgcctttgagcttggcgagtagaaagttatccaaacgttgcccagcttcatcatcactgatcgtaaaaaattgaacgctggcactaattactttttctgttgtcattttgatataaagaaaggaaaaatgaattggattttatcacaaattctgtctcgtgttagaataggctgaaattgatataggagaacataatgagtaccacagaaaaaacaaaagaaatcatacctgaaatcactttaccctctgaagcgaaagagattattactgatgtaaaaaatcttgaacttcaacaactcctggaaaattggattattccctatggcactaaattgttaattgcaattgcgatttttgttatcgggcgttatttggcaagggctatcagtacccttatcggcaaagcggtattagcatcaagcaaagatgaaatgctacaaggttttgttcgatctatcgcttattttctgtttttgctgattacagtgattgcctcactttcacaattaggcattaatacgagttcgttagtggcattgataggtgcggctggtttagccattggtttagccttgcaaaactcattacaaaactttgctgctggggtaatgctattaatctttaaaccatttaacaaaggcgattttattgaagctggtggtaaatcaggcaaagttgagcaaatggggattttgatgttagagctaagaacggtcgataataaaacggtgttgatcccaaacggtaaagtatttgccgacagtatcaccaactactcccgcaatgaaactcgtcgcatcgacttcattttcgatattagctatgagtccgatattgagaaagctaaagagattattgctcaaattctgtttgaagatgaaaatgttttacactatccagagcctaccattgcagtcggtaacttagcggcaagcagtgtgcagttatttgtgcgtccgtgggtacagacgaataactattcaactacacaatttgcgattttggaaaaagtaaaaattggctttgataaggctgggatttcgattccgtataatcagttagatttacatttgcctgagcagacctcggtaacctttactaaatagtgaatcctaataattaggggaaaaaatatattctgttttccataaatagaatattattttgtgagttccccgctatttatagtggggctcatagaatttttcaggttatttaggtattattttttccgattataaatttccttagccttaggcactaaacgtgctaaattcgcttggcgatcttcgtttgacgggtgagtagaaaaaatagacaaacctgaactaccattcgcttggctcattttcacccacacatttggtgctgcttcggggttataacctgactctgccattaacatcaaaccgacttcatcggcttctgtttcttgactacgagagaagggtttattggcaactaaatccacccctgcactgagcaagccttctgtattcacgcctgttgttgcggtcactgcaacatcagcaagtacaccaacaatacctgtcactgtgctaacagtacgatctgatttgccatgttcttgcaaagcgtgagccatttcatgtcccatcacaaccgcaatctcgtcatcagataaattcaacttatccaccagccctgtgtagaatgccatttttccaccaggcatcgcccaagcattcaattcacttaatttcagcacaatgatttcccattgaaacggcactcctgttttatttgctcgttccgcataaagcttcatcttattgaaaaccgaatgaatgcgatgagctgtcgttgagctagtatctaacatactttttgctcttgcttcctgcttcactttagcataattactttctgcttcttgattaatttgggctgtgctaacacaagcggttaaaagtagtgaacaaattgctataacgctaagattcttgaaaaatttcatacttaattcctatcataaaaaatgccaaagcgtttactttggcattatattcggttaatagtttaattattttttcgcacgttcgaaagactctaagatctcttgacgagcttcattcacatcgccccaaccttcaactttcacccatttgcctgcttctaatgctttgtagctttcgaagaagtgttggatttgtgcttttaataatgctggtaagtcgcctacatctttaatgtgatcgtactctttggttaatttgctgtgtggaactgcaactactttcgcatcgccacctgcttcgtcagtcatttttaacacgccaactggacggcaacgaatcactgaacctggttgaagtgggtatggcgttggaactaatacgtccacaggatcgccatcagaagaaagggtatggtttacataaccgtagttcgcaggatagaacattgctgttgccataaaacgatccacgaaaattgcaccactttctttatccacttcatatttgattggatctgaatttgcaggaatttcaattacaacataaatatcatctggtaactctttaccagcaggtacgttttctaagcccattttggtttccttctattaaataagggtgaaaaattggcgagattataacggattcatttccaatcagcaaagcaagcggtgagattctcacaaaaatttgcaaaaaataatagggttctgaccgcttgtagtaatcaagtaattacccaccttaccgcaaacaaatgttcaaccttacgctgttgttctaatttatctcggatacgagcaaataacctatctcgctcttcctcaatttcctcttccacatcaaaaatatttgcccttaattgtcggcgttttttctctaaatctttcaattgtgtttcaaaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaagttgttctaaatttgctgcttggtttttctcacgtttgacttgtttgattttttcactcacttccacaatggcttcctgagcagccttgattttatcttctgcccatttatccaaacgttcgctttcttgttttaataacgccatttgtgtttcagcctgttttgcacttatgccctgaatagcttgattggcattgctttgtaagtcatcgggtaaagcaacattatctgcgtttacctgagccgatacgctaaacaattttcggcaaaaatcctcatctaaccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgttggttcaaaaagttaattactaccacatcaaatttttgcccataacgatggcaacgaccaatgcgttgttccactcgttgcgggttccaaggcaaatcgtaattgataagcaaggaacagaattgcaagtttaccccttcggctgctgcttcagtggcaatcataatctgtgcattgttcttaaagtgatcaatcaacgccgtacgcatatccacttgtggagaacctgttattcgaccggcattattttcatcagcaagccactgttcataaacgcgtttggcatcagtgtgatgattagcacctgaaaaactcaccacttgattggcatagccattggcaatcaaaaagtcatataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaggcttgcgttcgcacactttctgtaaaaataatcgctttttgagctgcaccaagttccgccattttggcaaaaccggtttgtagtgcggttaaaagtgaacttgctttactatcgtggcgtaattgtttggtttgtgcgataaaaccttcaatttgagcgatttcatcatctagtgtttgacgatcatccgatgttaatccttcatcatcatttgactcatcatcttcccactcttcatccaactcatcggctaagtctgcttcactctctctcaaatcaagtaataaatattcttgtttagcctgttgttctttgagtgtataaaggcgttttaagataatgctaagcgtatccgccacggcataagggctggaagccaataatttacgcaaaatcaagccaatcaaatgacgttgtcgcttcggtaacgccaagctatgttctttgctgataaaatccgatacagcttgatataaagcctgttcttcatcgcttggatagaaattttgggtaagcgtatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcaagcaaggtagataaaccataaagttccatcaaactattttgcaatggtgttgcagtgagtagtaactttttacgcccatcaaatgccgagcgtaatgtttgccccattttattactggtacgatgggcattacgcagtttatgcgcctcatccatcacgacgcaatcaaacagttctccggccaaaaaattcgcgaatttggttgcatattggtaagaaataattatgactctcttgcccatgttggcttgcaaaaaacttggcaagctgccttgatattcttgttttaatagcgatttatccaaaatcacacaaggtaaaccaaacttttcagccaattcatttgcccactgtttccgcaacaccgcagggcagattaccaacaaacggcgttttcgttccgcccataattggcaaagcaccaaaccagcttccaccgttttgcccaaacccacttcatcggcaagcaatacgccacgcccaagcggatttttcagtgcaaataacgctgcatcaatctgatggggattaagatctactttagcattaaataaaccgtctgaaatacgagccactccattttcggaacgacacaaaatttcattggcaaaatacttcgcttgatacgctgtgatattcatacaaattttccaattacctactgcatcaacaaatgaaacaattcaacattaatataaaaattttcttttcctattttggttttcgctaaaacacctaaagcaaccaattcgtcaagacgcttaacggctgtattacgatggatttgacaatcttccattacaaagtcaatttttgtatagggatatttgaataaattatttaataattcatgactatacactttaggtaaattttcacgaatcatctgtttttgcttcatcattagagctttgatttcattaatcaatttaaccgattgaatagccgtttcagcaataccattaagcataaaaatcagccaaggttcccattgttgggtttctcgtactgcttgtaacaattgataatattcacctttgttgcgattaatgtatcgtgataaatacaaaacaggcgtatctaacaatccttgctgaatcaaatacaaaatattgataattctccctgtacgaccatttccatcgtaaaaaggatgaatactttcaaattgatgatgaattaatgccattttaaccaaagggtcataatccatttgttcagaatcgttgataaacctttctaaaccagccatcagattttcgatttcatcataggtttgaggtgacatatacaccacttcttgcgtggtttgattcactaaaccggttcctgcttgtttgcggaagcctgcgttattaccttccaactcacgctgtatctctttaattaaatttagggttatcaaaccactcttttgtacttcatgaaatcctaaactcattgcctgaacataataatgaacttctttagctgccccagaagcaaattgctgtgtggcgtaattactctgatataagtcatcttgtgtggttacaatattctcaatttctgaactttcttttgcttcttgcaaaggcaaagtaccaagcaaaatattgggatttggcatcgtatgcacgacaccttttaactcccccaatgcacgatgtgcgtgggtacaggctttaaaaacagatttgctttccaaatctcccaacgcgaataaatcaggaatgacgtaattcatacttcgttctcatcaacataaaaattaggaataacgtgtacattcacacaacatacacaagaaatgggattttcttgtgtatgttattccgatatgcacacaaaatccacttttcttgtgtacgttattcctactttaccatttcaagtatatacaccactattgcagcatcatcttaaacatctgtttgagataaacctgattgccgtccataaataaaatatgtttctcggcgaaatcttgtgttgttaaatgccccacattgagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatgccccacattgagcaaatctgcctgtttggtaatggacaaaataaaggcagataaaatcggggtctcaatcttcaattcacgagctaatttttgcaactcatcgtataacccaaatttggcattgtctaaatccatattgcgaatgcctttcggatcaatcaagctaagccattgtttacctgtttgattgtccacaagccacagcaaaaagtcgggatagaaattgcccgccaaagcaaaacccaagcctttggacttattggcagcattgcgtaatagatacaaatctttgccttgtgtccactcgctcaacttgccacttgctttggcattgactaaatcactgattaaacgcagttcactttcatcgccaatggcaagcggttgaatactaaacggcaaatcttggcgttctaagcaagcaaaaatgggtgcatacaaatgtccatcaaaacagagcatttgcaaacctttgtcgccaccataaacaggttttaccccattgctaaactcactaatgccgtctgctaaggcttctaatcgttgtttgatttcattaccttcgtcattatcaggcaaactaaattggtatttatccaacatagagccattgctgtcatccaccgtaaccacttcataaaactgcccttcgtaggcagcttttaagcggttataaaaggctttcacatattccagcaataaatcgatcaaaatctcttgctgcaacgccacttgggcaaaactatccatctttaacgccgcttgtggcatatacaaacgataccaatgactttgctcggcaaattggcgtaacttcgttttatctaatcgcaagttataccaagattgctgatgtttgaaacgtgccacttgcagataaatcttatcccaatcaaaaaaatcaaacagtgccgaatttaacttcacttcatcacgctgttcgccttgcacttgagtgattgccgtgcctttggtggcaaaactttgcacttttggatagcgatctaggctaatttcaatccctttaattttgttctgccatttttcaggaatttcaaacagataaatctgcttttctacccgcttaaacgactgcttacgattgcctttgacttcttctttgagttttaaggttttcagtttgatggcaggcaagcgtttttgtacagggaaatccaacgtcagcatttcatcgccggtttggatatcttcatcgtccaaatagccacggaacacttccatataatcagcattgataccaaaaatattcagcgtttccagtttttctaaaaagacacctttcgggcgaacgcttggcaatgaacgtttgagcgaccattcacgcccttttaatcgcacaccacgcccaaataactgaataatctggctaccttcgcctttgcccatattgagcaagcccatcgtagaaacacgccagcttgaccaaccttcagtaaacttacgtgaaccgattaagatattcaccggggatgttttatgattaatttcagcaaataaaccgccattaaactcatcgctcaccgcctcaaactcatcggcaaaattttcttgtgcggttttcagcaaaccagaagcatcgccgatattgataacaccaaatttctcgccttgttcgccaagggataatgccagttcgccatcgctttttttcaaatgggttaaacgcagacggcttgaatgtgtcgccccaaaaatcttacgcaacatatcttgatacaaagcatccacgtcatcgacaaaagagagtaatggcacaaaacgccctttgaaaaggtgttcattattcttacccaatatttgaggattatctagtatgagttctttcaaccacttttttacctgttgagattgattcacaaagaaagccagctgtcgaataacagttaaaatatcagatttttctactttttgttcttctgtttctttattactttctttaacacgatgccccacaaacaccatcaatggcttttcaatattccattccgccaatgtcgatttgtgttgttcaaacaaataaagttgttgataaaacgacaacaaacctgccacaaaataaacaggcaaatgcttatcaaaaccttgtttttcaatatttaaaatcaggctctctttaccatagccatcgtgataaaaatgcttataggaataatcaaacaacaccgatttagcataagtttcaagcactgcagtggtgcgaacctttgccatttccagctcatcaagggttaatttggctaagtcgtcttctgataaaccttttaacgaacctttattaaacaataacttggctttcgctttttgcttgtcttccacttgtttagcaatggttttgccgcctgccaccgcttgcccaagcgttgccgaatattcaaaggcaaaaccgcctttgactaaggcttcacggcgtaacagccactgttcgcccgatatgccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgtccaccaacaccaaattattgccttcaaaggcttctaccgacacggttttatcgcccgatttgtcggcaagtttattgacatcaatgatttcaacgcacttgccaatgcccacttcatccacgctaaaattaaaggttgcctgtgccgtggtatttttatcaaaaaaactggcttgaaagcctgacaattcaagctcttctttatgctgacggcttaaaccttcgtttggggtaagcacaatcactttatccgggcgtacaagcggttggtttttgccgaaataatgcaaatactgcaaaatattgacgtgcattaacaaggttttgcccgaacctgtggcgttccaaaaagcgattttatttaaatcatttaagcgatactcttcaaaatcttgtgcttctttgcccatctctttggcgtattgcaccaactgctgattaagtgcggtctgcaactcggcttttttattaaaataccaatccaaataaatttcggtaaacaatagcgatagatactggaagtattttggacgcaaaatatgaccgcttgtgcgattacgcttttccgtgattttttgccaataatgcaccaaccgcaaatcataagcggcaagctccgcaaggcttagcggattatcgtgttcaaaaaacagctcattgcttaggcgatgataaaaatggctctgcccatcgctggcgatatagtcgtcattttccacgctttccaacaggcttttaaactcatttaacgatgttttgtgaaatagcgaaaacagccaacggtttaaaatcaaatgttggtcaaaatgaaatttagcgtttttgggtgcttttgccattatgcgtccccctcaaacatcaaggataagaacgcatcttcaatgctgacaatcttcaaactaccactttgctcgccgtcccacaccgtttcaagggtatggtcgccattgatatagacttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaccttcgccccaatcagataattaaaggtttccaccaaatccactttttgccattcataggcaccggcgctggtggtgctaatgtttaagccataatcaaagggtttctcaaaatgcgaaatattgagcaaactaccccggctgtcgatattcagcatatagttcagcagataatcttgttgtgcattttcaggcaagtggtcaaataaatcactacggcgaagttcaaggttattcagcgtatcttcatagctttccagttttagcactttaacaatttgcggtacaccttgtagattttccgcaccatcttccgcaacgggcttaccgtctttccacgctttgctataaatcactttttgcacacgcggtttgagtaccgtatcaaaatattcaccttgttccacaagaatatattgacggttgcccttatcttcacggtttaggttaattacagcgtgagcggtggtacctgagcctgcgaagtagtcgagaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtattatacggcggatcaatataaatacatttcacctgttcacgataacgggcttgcaataaatttaaggcttggaaattatccgaatgaatcagtgtgccgttgatatggctgtcaaagtcgcccagtgagcgtgaaagtgtggaaattagtgcagattggaatgtggcagaaaagagtgatgtatccacaacaagatgttgtaaatcatcgtaaccatttgaatttaaaggcgttttaccccccccctgcattgtttgctttttgagcatttaaaaatgcttgagcacccgcagacggcaggttaaataggctttgccattgggcaagttgtttgacgttatgggcaatttcttcaataaatttgcccgcttgtttgagctgcaaaatatggttaagggtaattaaatagtgatgccctgccacaaatttctttttcagccacagttttttctggaaattttccaactgtgccaaaaaggcaataagctctaaagcaatgctacgtaaggtttgaattaggcgtaaattggcttcaagcggtgcgaaatggctaatgttttgcacatcgtccaaattcatcacttcgtttttaatataaaaatccaattcacggcgtaaaaaaccgcctaaatctttgtgaataaaataatcggcactgtttttctgggtgtagtcgcttaaatgtttttccaataaagtgcggttaggatttttttcggttgggcaacgctcggctaaggcaatccacttggtttgtagcaaatcgtgtgcttgcaacgtggctaaatcttgttccaaaattttctcttgttttgccgacttttcaaacggtttgtaatcaaacaaaatggttaaggtgttgccgtcttcgctttgnnnnnnnnnnnnnnnntcaatgatttcggtttcgccatcttcattttcacgctcaatggtttgggcggtggcaagggtaaacaaacgcttcgcatcgttatctttgcggttgtctttggcaatatcggcactgtttaaacggaaaaagacggtgcgaccatcattaaggctaaaacgataattgctgaaattctcgcccgatttggtgtagtactgatctttattcgcccaatgtagcaacacttcttcgcctgcataaggcaccgcataagtatcgcctttataacggcgttggctgataaaatcgccttcttcgtaatagcgactgaaaaaggttaaaagatggcgataaaccgccgtctcgtgatcagcactgccttttttggcttgttcaattttgctttgcagttcttggacttttggcgattggtttgggtcaatgcctagctcttgggcttgttttttggcttgctccagttccgcctgccaacctgcgatttgctcactttggttatcacccaacgcctgcttcactttttgtggcaaggtttgcgaaagatacttttcaatctcttggctacgcgtgtttaaaatccgataaatcccaaaatccaaatctgcacggttgatttggaagatttctttgagtttatgagtgagttcgataagttgggacataagaattccttcaattttaggtaaatttggggaattatagcaaagataacttgagtgttaaggctcttactccgcaaaaatttgcaaaaaataatagggttctgaccgcttgtgattttatttagtgcaatgataaattctaataatgtcaatttacgcaataacaaaaacagctataatcaaactcgcaaaaacaactacagtatgtaaacacaacatcaaacattcaacattaacaacacaggatttttattatggctaactatttcaacacattaaacttacgtgaaaaacttgaccaattaggtcgttgtcgttttatggatcgtagcgaatttgctgacggttgcaacttcttaaaaggcaaaaaaatcgtgatcgtaggttgtggtgcgcaaggtttaaaccaaggtttaaatatgcgtgattctggtttagatattgcttacgcattacgtgcagaagcgattgcagaaaaacgtgcttcattcacacgtgcaacagaaaatggttttaaagttggcacataccaagagttaatcccaactgcagatttagtgattaacttaaccccggataaacaacactcaaaagtggttgcagatgttatgccattaatgaaacaaggcgcagcattcggttattcacacggtttcaacattgttgaacaaggcgagcaaattcgtaaagacatcactgtggtgatgacagcaccaaaatgcccaggtacagaagtgcgtgaagaatataaacgtggtttcggtgtacctacattaatcgcagttcaccctgaaaatgacccgaaaggcgaaggtatggcgattgcaaaagcgtgggcaagtgcgacaggtggcgaccgtgcgggcgtgttagagtcttcgttcgtagcagaagtaaaatctgacttaatgggtgagcaaaccatcctttgtggtatgttacaagcaggttctatcgtgtgctacgacaaattagtggcggacggtaaagatccggcatatgcaagcaaattaattcaatacggctgggaaaccattaccgaagcgttaaaacaaggcggtatcacattaatgatggatcgtctttctaactcagcgaaaatccgtgcctttgaattagcggaagaaatcaaannnnnnnnnnnnnnnnnnnnnttaaaacatatggatgacatcatcagcggtgagttctcatcaaccatgatggcagactgggcaaacggcgatgcaaacttattaaaatggcgtgaagaaacaggcaaaacggctttcgaaaattcaccaaaagcagacggtatcaaaatttctgaacaagaatactttgataacggtgtagtgatggttgcaatggtaaaagcaggtgttgaaatggcattcgatgcaatggttgcaagcggtatctacgaagagtctgcatactatgaatcattacacgagcttccgttaatcgcaaacactatcgcgcgtaaacgtttatacgaaatgaacgtggttatttcagacactgcggaatacggtaactacttattctcacacgttgcaacgccaatccttgctgagaaattaatcccaatgttacaaaaaggcgatttaggcgaaccaacaccaaccgttgaaatcgacaatgtatatttgcgtgatattaacgatgccatccgcaaccacccagttgagctaatcggtcaagaattgcgtggttatatgacagatatgaaacgtattgctgttggtgactaatttttagtgataaaaaagcctgctatggaaatagtgggctttttgtgtttggtttaattaatatgaggctttggtattctacaactagcccttacgttcgcaaagcaagagcagtagcgcattatcataacttgcaaaattaaattgaattaggggctgacgtagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaatacacccaatctttcaaacaaaaagtcatcgaattttattaaaacaaagcgacataactacaacaaaaaaagcaagataaataacaatttcgcttttttcacatacagcaataaaatttcattttttagagaaaagggctttaactattccactagctaaagcccttttagtcttttttacgtctttagtgacgttttcaatcaatcagaaaaccgttttttgacggtgcaagcaaacaatctgattgaaaggtaaaacctatttacttaatacaacctttaattaaataacctgcggactttccaacaaggaaaggggcgttaatatccgtgcaacgaataatttccactttaccgcctttctcttggtaagtatcaacaaataagccgtctttacgtcttaccgtgtaaccgtaagacggttcaaaaatattgccttttttgcctttatctttaccgtttgcaacataagccaaaacaatgctatttgaccagattttttctaaattgccatctttttcttgagaagctgcaccgatttttaccgtttcaacgccaatcaattcagcaaaaatttcaggggttaaaatgcctgtgcgagtgtatttgatacgttctaaaaggtttgtattttcttttaaaattttccaaacatctgaagcaattacacaaacattgggcaaacgcccaatagtagcagaaacagcttctaaaccatcattgatgaattttaaagggccagattttgcatttgtgaaacgttgtgtttcagtcagtgtaacaacattttcagctgaataattctctgcattttgtgcaatttcagcaacagccacttcacgccctaacgcaatgacatcttgaacaacagaaagagcgtattttttcaaaggatagctggcatcattatcttcacgataatcaatagggtattcaatatcgtgttcttttaattctacgcttaaacttgttacatcttcaggcgttaagcggttagagtcgccgtgtaattctcgaacggttgaacgagtgcgaaaagctaaacgcccaaactgtgggattttgcccgcttcttttgtaaggttatcaaatttaggaatatacaaatttaaacctccattaaatttcccaaataattctaaaaaatgaaacctaaactttgctttatcaccttgtgccttttcgtaagcttgttcaatacaactgtctaaagtttcgattaaattattgtaagcaacttcagcattgttcatatatcgctctgttttaatcattcaaccaataccgcaaactttaaactgatttataaaactgctcttttaaactactttaataaaacacttatactgcaatacataactaatgccaaatacaacaagcaagaatcaaatttaaggcgtttacgagcgtttataaacacactaaaagacaaaagagctacacttgttcggcttaaacagaaaaagggcttaaaagggcgtttttgtggggattggtaaaatttaggggaaatttgaccgcttgcaagaaaagatttgaatggttcaacttaatgaaagaaattctattttataaaaatcaaatagttatgagtaaacaacaatgattttaaagttgaacattcaattttttaattaaacacttgctatttatcttaaaacgcgtatgactgttctcaaggtgtcgtaaccttacacaaagcggataaccgcacccgatagatcaagcggttttttgtacctaaaatttgcaattttggggcaaaaggcacaatttatttaaactcaataccgagggggcgaggaatacaacacccgaaagggaaataactccagccgtctttgtgtggcttacgaaccccttggcaccctattttatagggtaaaatttcgtaaatacacaaaggagttcattatgaacgctcaacagttccccttttctcttcaaacaaaacttatcaataatcgccaacaatcttttatttcattaaaagagcttgcacacgttgcttttagctggcatccaaccaccaaagaaagccaacaacatttaactaaattaggctttcaggctgaacaagattatttgattattcaaaataaagcacggaatgaaacgcttgatttttggctttccattgaaaccgccattagctttatagataaaacaacagactgctggacaccaattatcaaacgttgcttagaagccttgggcgaattacgcaaaatgaataaatcagccgtaaacgagctacggccagcgataaaccaacaacgttttattgtagaaaccaatgcttttttaaatacttattttcaatatgaccatcattttttaattagtgaagatgattttgttgcacttgaacgaatgaaaggggcttgcaccgcttttgagcaaatgctacttgaagtgaataataaccgttcattaagctatgaagccttagccgatttattttcttgttgtaccgctcctctatttgacgtgctgaaacgtataaaagacgtaggcgatgaaaccaatacaattaaagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatcttaaccaaacaacaatttcccccagcgaatacaacaaatcattgctagcgatgccgcataatttcttgctaacttatcgtaccgagtcgcaatggctcggtattgttttaaaaaagcaaacgcattttcaactaaatggcgataacgatataaacaccagtctatatcatcattacccacctttgaatttcgtctgcgaggtataaccagaactgcttttgttgtcaaaataagcactcgtaaggcttcacaatcataacctctgtctgcaacaatggtctcactgtcaggtaacaattccacaagctcagacgcagctttactgtcgtgaacttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctagacattttgaataaattaagagcatacaagaaaattttttaaaaaagtgctagacaagcgagagtgaaatcactaatatacgcctccgttgcgacgcagtactgaaaacaacgcgttcgtagctcagttggatagagcgttggcctccggagccaaaggtcgcaggttcaaatcctgtcgagcgcgccagaggtaatgcaatatcgactagaaatggtggctatagctcagttggtagagccctggattgtgattccagttgtcgtgggttcgagtcccattagccaccccattaaatatatgcagtggcatatcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccataagatgagcccaagtgggattaggtagttggtggggtaaaggcctaccaagccgacgatctctagctggtctgagaggatgaccagccacactggaactgagacacggtccagactcctacgggaggcagcagtggggaatattgcacaatggggggaaccctgatgcagccatgccgcgtgaatgaagaaggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctccccgaaatctatttaggtagagccttatgtgaataccttcgggggtagagcactgtttcggctaggggtccatcccggattaccaacccgatgcaaactgcgaataccgaagagtaatgcataggagacacacagtgggtgctaacgtccatcgtggagagggaaacaacccagaccgccagctaaggtcccaaagtctatattaagtgggaaacgaagtgggaaggcttagacagctaggatgttggcttagaagcagccaccatttaaagaaagcgtaatagctcactagtcgagtcggcctgcgcggaagatgtaacggggctaaaatatagcaccgaagctgcggcatcaggcgtatcacaaatacgccttcgattaacaacatcgaatgaagtgaaacggaataagatgttggtcaagcacccaacacgttgagttggcataaagtgcggatagaaatcagaggaatatttgtgatacgcctgttgggtaggggagcgttgtgtaagtcgatgaaggtgtattgagaagtatgctggagatatcacaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgtctccacccgagactcagtgaaattgaaatcgccgtgaagatgcggtgtacccgcggctagacggaaagaccccgtgaacctttactatagcttgacactgaacattgaattttgatgtgtaggataggtgggagmctaagaagcagkcacgccagtgmttgtggarkcgwccttgaaataccaccctttaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacaacactctcatttttgtataattttaattaaaaagtttaaaaaatgttacaaaataaatttttttgttctatacttgaacaaatttaagatgtaggacaaatagtagtcagttgattaaaaggaaaagttaagatgctgtgatttctgctatattggacagtttagaattttgtattactagggagaaaccttatgtttggctttgatccgacaacaacgacgtttctgatttatattatcggaatggtcttaattggttttgttgcttatcgatttacgaataatttatcggactatattttaggcggtcgtcgattaggtagttttgtaacagggttatcagcaggggcatcagatatgtctggctggttattaatgggtttacctggtgcggtttatgcggcaggtttggttgagggctggattgcaattggcttgaccataggtgcttaccttaactggttatttgtagctggtcgtttgcgtatgcatacggaatacaatacgaatgctttaactttgcctgactatttccatcaccgttttggcgataacacaaaaatcctcaaaattgtgtctgctactattattctatttttctttgccatttactgtgcttcgggcgtagtcgcaggggcaagattatttgaaaatttatttggcgtgccgtatgccacagcgttatggtatggtgcattagccactatcatctatacctttattggtggtttcttagcggtaagctggacggatactattcaagctagtctgatgttatttgctcttttcttaacccctatttttgtgttaattcatttaggtggctttgcggatacgcataatgtgattattgctgcagggcaatatgtcggtaaggattttactgatatattcacaggcacaacctttgtcggtctattaagtttagctgcttggggattgggttattttggtcagccacatattttagctcgttttatggctgcagatagtgtgaaatcaatgccaaatgctcgtcgtattagtatgacttggatgattatctgtttatttggggcggtagggatcggcttctttgggcaagcctacttcttcgcaaatcctgaacaggcggctgtggttaatcaaaataatgaacaagtctttattgaattatctaaattactctttaatccttggattgttgggattttattatcagcaattttagcagcggtaatgagtacattaagttgtcagttgttgatctgttcaagtgcgattacagaagatttctataaaggtatgattagaccaaatgcaagtcaaaaagagctagtttggttaggtcgtatgatggttctcgtgatttcagtgattgccattgccattgctcaagatccaacaagccaagtattaaaattagttgaaaatgcgtgggcaggttttggctgtgcttttggacctgtggttattctttcgcttttctggaagcgaatgaatgcggctggtgcaatggctggaatgttagtcggggctttagtggtggtattttgggataaattattacctgagagtgctgtctacgaaatgatccccggctttatccttgcctttatcgcaatcatcgtggtttctttgattacccctgcccctaaagcagaaatcgtggaaacgtttgataaagctgaaaaagcctatgcagatgcaatcaaataatttatctagaaacggtttgccatttggcaagccgttttttgcttttaacaagcggtgagattgcagtgatattttgcaatcatctcaataacaacaatgaaacgggagaaaaacaatgtcagccacatctcattatcatattttgcctcaaggtaccgctattcgcccaacgttaagtgaacactatcgttgtgatgaagagcaactcgtcaaacaacttattccgcaagctagagtagatgaacacgccgaaggcattaaaacgcttactaaaaaactcgttgaaaaagtcagaaatgctcgtcagaaagccagtggtgttgatgcgttgatgcacgaattttccctatctagtgaagagggtgtggcattgatgtgtcttgctgaggcgttattgcgtattccggacaaagcgacagccgataaattaatccgtgacaaaattgccaaaggggattggcgttcccacgttggcaatagcccttctctatttgtcaatgcggcagcgtgggggttagttgttacgggtaaactggtagctacccacagtgaaagtagtctggcttcttcgctttctcgccttattcaaaaaggcggagaaccgcttattcgtaaaggggttgatgtggcaatgcgtttgttaggcaaacaatttgtgacaggggaaaccattcagcaggcgattaaaaatggcgagaagcggttcgcaatggggtatcgttatagctacgatatgttaggtgaggcggcattcacagaacaagatgctaaacgctattatgatgattatgttgcttctattcacgctgtgggggcggtttctcgcggtctaggggtgtataaatcttccggggtatcggttaagctctcggctattcaccctcgctatagtttagctcaacacaagcgggtaattgatgaactttatccacgtttgaaagatctgtttttattagctaaacagtacgacatcggtttgaacattgatgcggaagaagcggatcgtctagagctttctttggatttgatggaccgcttgattgccgatcctgatttagctgactttgctggtatcggttttgtggttcaggcgtatcaaaaacgttgtccttatgtgattgattatttgattgagaaagcccgtgcgaaccaccgtaaattgatgatccgcttagtgaaaggggcttattgggacagcgaagtaaaacgcgctcaagctgatggtgcagaaggttatcccgtattttctcgtaaagtccatacagacttaaactatgttgtttgtgcgaaaaaattattgtcggcacaagatgtgatttatccgcaatttgctacccataacgctcaaaccctttcaaccatttaccatttagcacagggtaaacattttgagttccagtgcttacacggaatgggggaaactttgtatgatgaagttgttggctcacataatctcaatgttcaatgccgaatttatgcccctgtaggttcttatcaaacgctcttagcatatttggttcgtcgtttattagaaaacggggcgaacagctcttttgttaatcagattgtcgatgaaaatctcagtattgatgatttagcttgcgatcctgtcgcaaaagcccaaataaccgaaggcacaatgcacccgaaaattccattgccagttaaactttttgcggaacaacgtcaaaattctaaaggctatgatttaaccgatgcgatccacttaaaaacattagaagcggaattaaatcaacttgcaagccgacaatatcgtgccgagccacaaattgcaggcgaaaaaactgaaaatcttcattctcgccaagttcacaaccctgcaaatatcgcagaagtggtcggtgaggtgattgaggcaacagaaaatgatgtggcaaaagcctttgcagttgcggaacagtttaaagctgagtggcaaaacacgtcccctatagttcgagccgaagcacttgaaaaaatggcagatttgatggaagcaaatatgcctcagctctttgatttagccgtacgagaagctggcaaaaccttaaataatgcgattgccgaagtgcgagaagcggtcgatttctgccgttattatgcaaaagaagttcgtcaaaaccctgaaggttatcgcaatccgagaggaattgttgttgctattagtccgtggaacttcccgcttgcaatttttgtgggcgaagtctcctcggccttagtggctggtaatgtggtattagctaaacctgcagagcaaacctccttaatggcatattatgccgtgagtttatttcatcaagcaggtatccctgagcaagccttacaatgtttaaccggtagcggaaaagtgatcggctctgccttagtgagcgatccacgagtaaatggcgtgattttcacaggttcaacggataccgctaaaaacatcaatcgcaatttgcaaaaatcagcccatatcgtaccgcttatcgctgaaacaggcggacaaaatgcgatgattgtcgatagttctgcgttaggtgaacaagtggttgctgatattttaaactcagcctttgattcggcaggacaacgttgttctgcattgcgagtgctttatttgcaacgtgatgtcgcagagcatatcctgacaatgctcaaaggggcaatggcagagttaaaagtcggcagaccgcaaaatcttaatacagacgttggtcctgtgattgataaagtcgcccaagagcgtctgcttaatcatatcgacgaaatgaaaaaagtggcgaaatcgtgctatcaagttccgattgatcctgaactgtctcaaactggcatttttgtaccgccgacgctactcgaaattgagcatatcaatcaattaaaacacgaggtatttggccctgtgctacacgttatccgatttgatgcagataatctaccgcaagtgatggcagacattaactcgacaggctttggcttaaccagtggcttacatagccgtattgatgaaaccgtggatttatggcttgaaagtatttacgcaggcaatctctatgttaatcgaaataccgtaggggcagtcgtcggggttcagccatttggcggaatgggattatctggcacagggccaaaagccggtgggccactttacctacaacgcttagttaatcgctgtgaatggacattatcgggtttagaagggggcaaaccagccgacacttcaggcttactcacaggcatacaagcggtgctttcaggcacagaattacaaaatgcccaagatcttattgcaagtctttctcgccagtcgccgttagggaaagtctttaaaatgcaagggattacaggggaagtaaactttatgcaatttgaagctcgcccagttattgcaatcggtaatggctcactagagcaacaaattcaagccttgattgccgtagtggtgtcgggtagccgtgctgcggtacattctaattcgccactggctaaacaggctcagcattttgcaggcttagtgattattagcaatgatttcaatagcttagcaaatttaagtagcttgattgtgcttgaaccgctttcattagaagaaaaagctcactatgcagaacgcacaggggcaattctcacctatgtggaaaatcttgaccttgctctttcattattcccattactacacgaaaaagcgatcagcattaataccgctgccgctggtggaaatgcgagtttgatgagtgagatggattaattttaagataattggataagggctgagggaactcagctcctacaaaatgaatattatgcaatagttcatcatatcaagtttttgtaaaaaataaccaaatccaaccacttgcaaccactatatcttgtgtttctaatttttaaaaacacaagatatagtttttgagcgaaactgaatttttacaaaaaatttttccttttaaaatcaatcactaggacgacacaatcagggatagccatttgtcaagatcttgtagaacgaaaaaatatctctaaaatactccccattgaataatcaaccacgaagctcaaatcattatggcacgcaacatttttgaaaaacgcattcaaatcaaaccttatgaataccccgaattacttgagtttaaagatgcaattcgtcactcgtactggttgcataccgaatttaattttacgggggatattcaagattaccgtactaatattaatgaccacgaacgccacgttttaacccgtgcaatgttggcaatttcacaggtggaagtgaacgttaaacgtttctggggtgagctatatcattatttcccaaaaccagagatggacgatgtgggggggacttttgcggaaagtgaggttcgccataaagatgcttactctttcttgttagaaaaattaggcttaaacgatatgtttacgcaaatcacggaaattgagccgttgatgaaacgtattcgttatatggaagattttatgcgtgagaaggatacaggcaaagggcagtttgtgctatctcttgtgttgttctcgttgttcgttgagcatatttcgttgtttggtcagttcattattatgatgtctttcaataagcataaaaatctgtttaaagggatttctaatgcggtggaagcgacttcaaaagaagaagaaattcacgggcgttttggtattgcgttatatgaaattttgagtgatgagcatagtgaattatttacccctgagttttttgaagaactcaaaactttatctcaacaagcctttgaagctgagagaggcattttagactggatttttgaagagggtgatttaagttttatttctcgtaaaaccgtcgaaaactatattatgaatcgctataacaattcattatctattttggggttagaaccaccatacgatgtagatcctgagttgttaaaagaaacagagtggtttgatattgaaattatttcaactaaagaaacagatttctttaacaaacgtagtaccgattatagtaaaaaaatgaaacagattactgccgatgacttattctaatgattattatcagccaaagttattccaacttggctacactaacgtaaaccgtcctgattttgagtggttgaatgacgatagccgtcttttcttgcaacgtggctatttgttggaaggaacaactgctttagatcgtattcgttttattgcagaacacgcagagcgtaagctaggtattgaaggctatgcggataagttctactactatatgggacgtggctatttctcgctctcttcgccgatttggtcaaacttcggtttagatcgtggcttgccgatttcgtgttttggtagctatattggcgattcgatccacgaaattatggtgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccgctgaagtgggtatgatgagtaaaatcggtggcggtacgtcagcctattttggtgatattcgtccgcgtggtagtttgattaaaaataacggaaaatcagacggttcatttaactttagtaagttgtttgatacggtgatcgatgttatttcacaaggtacttctcgtaaaggacaattcgcaggctacattgatattgaacacggcgacattgatgagtggttggatattcataccgaaggtaatccaattcagttaatgtactatggcgtatgtgttggacacgactggcttgagtcaatgaaagcaggtgatccatacaagcgacaactttgggcgaaaattttgcaacgtaaaacagaaacgggcattccatatctgttcttcaaagacaatgcaaatgcaggtcgtcctgatgtgtataaagataaaaatatgacggttcacgcctcgaatttgtgtaccgaaattatgttaccgtcaaataatgaagagagtttcgtttgttgcttatcttcaatgaacttgctttattttgatgagtggaaagatactgatgctcctgaagtattaacctacttcttagatgtagtaatgtcggaatttattgagaaaagtgctgaaattccattccttgaccgtgcaaatcgttttgctaaacgtcaccgtgcattaggaattggtgtgttaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagaaaagacaatgaaggcttcagaagaacttgctcaacgctttggtgaacctgaattgttaaaaggctatggtcgtcgtaataccaccttaatgagtattgctccgacaaaatcaagtagctttattttaggcagtgtatcgccgtcggttgaaccgtttaaatcaaactactatgttaaagacttagcgaagattaaaacggtttataaaaacccattcttagagcaacttctcagagaaaaagggttagataccgaagaaatttgggaaagtatcttattgaacgatggctctgttcagcatttaacacagctctctgaacacgaaaaagaggtctttaaaactttctctgaaatcagtcagttaagcgttattcagcaagcggcacagcgtcaaaaatacattgaccaagggcaaagtattaacattatggttcaccctgctacccctgctcgtgatttaaaccaactttacttaacggcagaagaattgggcttgaaatcaatttactaccaatactcaatgagtgcggcacaagtgtttaaccgtaacttgttaagttgtagtagttgtgaggcgtaatctcttgctagaaaagcgatcttcgggtcgctttttttattccttttgataacttttgatagaaaaatcgccacaaaatcgctatacttcaccgcttttcagcaagaggaatttgcaaacaagcggtcgtttagctgccgatctttgcaaagaaatcatttatctttttcattaagaggatttgaagattggttaaatttgctcaatcatttttgaataaacttgctgtcgcaggcgttgcatttcttgcacttactgcacaggcagccgaaaaattgtatgtgtataactggacagaatatgttccatcttctttactcgaacaatttaccaaagaaacgggaattgaggtgatctactccacctttgaaagtaacgaagaaatgtactcaaagttaaaattaacgaatgggtcaggttacgacattgttttcccgtcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccgtcaagctattatgttgggaaaatggcaaaagacggaatgttagccgaaattgataaaagcaaattgagcaatttccacaacgtaagcaaagccttaatgggtaaagagtttgaccctgaaaacaaatactcacttccttatgtctatggcttaacgggtattggtgtgaatgcgtcagatattgacccaagcacgattacaagctggggcgatttatggaaaccagaattcaaaggcaaggtattgctgatgaatgactctcgtgaagtgtttcatatggcattattgttagacggtaaatcaccgaataccaccaatgctgatgaaattaaaactgcttacgagcgtttaacaaaacttgtgccaaatgtacttgtatttaactcggattctcctgaaatgccttatttacaaggcgaagttgcgattggaatgcaatggacaggttcggcatatagagcgaagagtgaaaatccagacttaaaatttatcttcccaaaagaaggggcggtaatttggatggataattacgtcattcctaaaaatgcaaaaaataaggaagcagcacataaatttattgatttcttgttgcgtcctgaaagtgcaaaaacggtaattgaaacgatgggtttctcaatgcctaacgaaaatgtgaaggcattattacctgcagaaacagtgcaagatccactgattttcccaccgcttgcagaaattgaaaaaggtgttttacaaagtgatgtcggcgatgccgttgaaacttatgaaaaatactggaatttacttagaacaaagcgttaattagaggttaaaaaatgtctgctcataatacagcaacagcaaattctggtccacttggtttatgtggtttcgcattaacaacgtggctattaagtttaatcaacaacggtactttcggtggcgaaaatgtaggcttagtgcttgcaatgggctttgctttcggcggtactgcacaaatgattgcaggtatgtttgaatattcaaaaggtaacacttttggtttcactgcatttatcagctatggtgcattctggtggtcatttgcattattaaaagtgttcttcggtgcaaccgtatcacctgaatttatcggttggtacttagtcgtttggggtacatttactttaatgatgttcttcggcaccttaacaaaaccgcgtgcgttacaagcgattttccttgcgcttaccatcacattctacctattagcagcaggtgatttcactcacaatgcaaccattacccacattggtggtaacttcggcttattaactgcattattagcattctatttagccgctgctgaaattcttaatgaaagttttggacgtacagtgttaccaattggtgcaccgaaataattttgcggtaaattagagaatctgtggtttagggtgtgttcaggagtacggaacacagcctttttgatctcagttttcctttcagaatggttatctatcgggaaatttattttatttgtgtattaaaaaataaaatactgtgatcttattttctattattctaattgccctattacttaatggataaacaaaaatgattggaagactttgtggtaggattattgaaaaatctcctccatcaatggtacttgatgttcaaggagtgggttatgaagtattgatgccaatgactagtttctataatctacctgatcttaatgaagataccatgattttcactcatctggtaatccgagaagatgcgcaccttttatttggatttgttcagaagcaagagcgtatgctatttcgtgaactaattaaaacaaacggtgtagggcctaagttagcattagctattttgtcagcaatgtcagtttctgaatttatgtctgctatagaacaggaagaattagcaaaacttatcaaaataccagggattggacgtaaaacggcagagcgtttgttggttgaattgaaaggaaaattttcaactttatttcatcatgaaatttctattttacaaccatcaggaaatcttttatcaatggcgtctatgagcccagtaaatgaagcgattgatgctttgatttcattaggatataaggcagcagatgctgaaaaaatggttaaaaaagtaaacaggaaatctgaatcaacaagtgagcaacttattcgagaggctttaaaaaatgctttgtagctatattgattgccctgagatattaggtatagtagacaaaacagttcagaaaaaatttgtctactatacctaaaagtcgacatttatgattcagatggaacgttttcttaagtagcaatgttcacttgaccttcaacaccaatatctctttgcattttttgcaaatataagaccgcttgtgttgcataatagcgttatgacggcggattgataaaaaatgcgtttggcaaccgcaacggtaggggaattgttgtcccgcaacattggcgacatcaaagcaatggtacgtttcggcaggcacgccgagaacctctttcatcatcattttccactctttgccgtgtggctgtacttgtccgaattgttgataaaccagcaggtgagcaagttcgtgtgggacaacttgttgcacgaagtttgagctattttcactcaataaaatagggtttaagcgaatttcattttgttgcaagtaagccacgccagcttttcgccctcgcactgtgtaacttatcgttgggggcgtaaagtgtttgttaaaatagcggtttgccttgtccaaatctcgttttaactggcgttggacttgcattttgagttcacgaagatgttgcactagcgagggcaatccattacgttccagctcttgtcgtaacaaatataaagttcgttgcgactggctccaagataagcctctttaagctgtgggttaaatttttttaaccacgcaaatagttctttgcgtgagagttcttgtcctggtaggttgaggctacggaaaagttgtttctgtttctcaaaatagtcttctgcattattgaacgcacaggctccgtgtttttcccattgtccttgtaacaaacttgcccctggggactctggtagatattgtttaatcagattttcaggtagttgagccaaatcgccttggcagaaacgtgggtgttcatcagctgatcttgcagttgccgattgtggccataaaccgtgaataacccaaccaaatttcgaggcttggttgcactgcaatgcaagatgagctgggacgttgccgttatttttgcttctctgttcttcgcaaaaacttggcgaccacgaaagtgctaacatatagtaatccacagaggcttgtaggttttgcccaaacttatcttttgccatattggtatcgtaattgcctaactggcttgggatttcaacattgttggtgctttgtgaaaccgttggtgctggcgttggttgcttacgttcttgttctttcttttcattgttaaaccaagtaatgacggaaaaaataccgatcaccacaagggaaatgagctgagtaagcgttcgtttttgagtggattgctgttttttcattggtaaatctaagcattagaaataaagggttactataccacttgcgtcagtggttgcaaaattccctgagaaaatctccgcttgttatttcttttagttatattaaatgccattcttatccttaacattaggctaaaaatccgtatgctaaccgcattcaaactagcacgaggaacataacaatgacaatttattcagacaactcacaaacgataggaaataccccgattgttcgtttaaagaattttggtcacaacgggaatttattggttaaagtagaagctcgtaacccaagttttagtgttaaatgccgaattggtgcaaatatggtatggcaggcagaaaaagatggtatcttgacgaaagataaggaaattgtcgatgccaccagtggtaacactggcattgcgctagcctatgtagcggcggctcgtggttataaattgacattaacaatgcctgaaacaatgagtattgagcgtcgtcgattgctgcgtggcttaggggcaaatttggtgctaaccgaaggggcaaaaggaatgaagggggcgattgcgaaagctgaagaaattattgcgagtgatccgaaccgttatattatgcttaaacagtttgaaaatccagcaaacccagccattcaccagcagacgacaggtcctgaaatttgggaagcaacagaaggcaatattgatgcctttgtcgcaggtgttggtacgggcggtacgatcacgggagtaagccgttatatcaagcaagataaaggtaaacaaatcatcagcgtagcggttgagccagccgagtcgccagtgattacacaaacgttaaacggagaagaaatcaaaccaggtccacacaaaattcaaggcattggtgcaggctttattccgaaaaacttggatttaagtttgatcgaccgtgttgagcaagtggatagcgaaaccgccattgcaaccgctcgtcgtttgttagccgaagaaggtattttggtcgggatttcatctggtgcagctgtcgctgccgcagatcgtttagcaaaattacctgaatttgcggataagacaattgtggccattttaccttccgcctcagaacgttatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtaccttgttgtttgaggggattgaaagttaatgtacaaaatatcgtgtagcaatgtatattctcatattgctatacgatctaaaaatagtcactttaatttaccttgaatgatcttatttgcacaccaagcaccccaagagtggcaaaatagctgattgcagcaagtacaattaaccacgcaagccaatggactttcgcccaaaaattcaatgtgttccaacctgttaaatccggagaaaaataggacactaacgcccccattacacaggcagcaatcagcagtttaagggtaaaaattgccgtggttgttgtgactttataaatgcccttttgagctaagccacgataaagtaagccagcatttaccgcagcggaaagtgccgaagccattgctagtccaataaaaccgaaaggaatagccagtacaccaaaacagatattacttaccgctgcaatcataccgattttgactggtgttttggtgttttggttagcataaaagccgttcgccaaaatactaattaacatatagctaattaagccaaagcacatcacaaacagagcttgcgaagaagcgataacatcattgagttgaaatttcccgtgcataaacatcgtcattatcaacggttgagcaaggatcatcattccaaccatcgcaggaataccaagcagtaataccatacgaacaccccagtccattgtttgctcaaagttaaatttacgttgttcttccgtcaaatctttctgtttggcaatacgagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattgtgataagccacctaaaaataccccccaggcaagtgccgtatcgggcgaggcaaagaaatcttttccccaaattgcaacgcaaataattgccacatttaacagaacaggggaaaacgccattacaccaaatttacctaacgaatttaaaatcgcccccgataatgcaacaaaagtgataaaccacaaataaggaaatgtaattttgagtaacaacgaggcttgggtaaatttttctgcatcaggtccatcattgagccaatctaaaaaccagcccgtaccaaataatgcagcaatcacaggggaagcaagcattgcgactaaggtgacaacagtgactaatccccccaacgttcccgatacttttgcaataaattcacgagttttgtctggatcattatcggcattatattccgctaaaacaggcacaaaggctttagaaaaagccccttcggcaaataaacggcgaagaaagttaggaatgcggttggcgaataaaaatacatcggcggcaacgcctgcacccagtaagttggcaaccaccacatcacgcactaaaccaagaatacgagaaagtagggtcataccgctaacaatcattcctgatcgtaataatttcttgctcacaatttgttctctttatcttcttaaaaaattgatcggaattttagcagtttgttataggaaaatcagaaaaaaactgctaaaatccgcctctgtcttttactcaagaacatttcttgtgtgaaacgatgttattttcaagcccgtgtctcgttgaaaatgaatttaaactatcgatagcactgcataaaaaattgttttttatgtttttatttttacacagatatttttaggagtttgaccttggctaatatcaagtcagcacaaaaacgtgcggttcaatcagaaaaacgccgccaacataacgcaagccaacgttcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccaacgttcaatgatgcgtaccttcatcaaaaaagtatacgccgcagtagcaactggtgataaagcagcttcagaagcagctttcgttgaaatgcaaaaagttgtggatcgtatggcatctaaaggcttaatccacgctaacaaagcagctaaccacaaatctaagttagctgctcaaatcaaaaaattagcgtaattgcttttttaaacaaatttgcaaattttttggaaaaccgaccgcttggtcggtttttttgatttgcataaaaatgctttcctacagcttatctatttgagaatagtaagcatcgtatcaaatctcataaaatttaatgtgtaaaagctaattctaataagcatagaaatagaataagagaatttatttgatactcaacgtaataaatattatttgtgatagaatctatttcaaattatctctatttttcttacatatgagcgttaaaggatctaaaccccttattcaaatcctccctccccaactcgccaaccaaattgccgctggcgaagtggtggaacgtcctgcgtcggtggttaaagagctggtggaaaacagcttggacgcaggggcaacgcaaattcagatcgatattgagaaaggcggatcgcagttgatccgtattcgagataacggctgtgggatcggcaagcaagatctcgctttggctttggctcgtcacgccaccagcaaaattgctacccttgaagatctggagagtattttaagtctgggctttcgtggtgaagccttagccagtatcagctcggtgtcccgtttaacgctcacttctcgccccgaatatcaggcagaagcgtggcaagcctatgcacaagggcgtgaaatggaggttgaaatcaagcctgcttctcaccctgtcggcacgactattgaagtggctaacttgtttttcaatacccctgctcgccgtaaattcttgcgtaccgataaaacggagtttgcccatattgatgaagtggttcgccgtattgcattagcaaaaccgaatgtgacttttacgctaacccataatgagaaaaaagtgcgttactataaagcggtggcgacacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcttgaacagcaacaaaaacgggttgcaacgatttgcggtgatgagtttattcagcagtcggtacacattgattggcaacacgacgatctacatatttacggctgggtcggctcaccaagtttagcgagagtgcaaaacgatctctgttacagctacgtcaatgggcgaatgatgcgagataaaacgatcaaccatgctattcgtcaagcctatggggaacggttgccgaaggatcattaccctgcctttgtgctatttttagatcttgacccaagccacgttgatgttaatgttcaccctgcaaaacacgaggtgcgttttcaccaaagtcgcttagtccacgatttcatctaccaaggtgttttgaatgctcttgaagatcaacatcatttacctctgacaacgaatgtcagcgagaccttgccgaattatattgccgacaccaaccgtgtggcttcggggcagaatattttcgctcacagttatcgtgaaccacgcttgacttcatcaactcacgcagaacgcccaaattacagcaatactcgctcatcaggggtaagcaaaagcgaacagaagtggtatggcgaattgctttctacgtcacctatgcaagactataagcggtcagaacctgttcaagatttgtcaaaaatagccaagatcacaccgcttgttgaaccgatagccgagccggccacgccctatgctcaagccttagcggtagtgaaacagaaagcattgttgatgaaacagggcgaaaccttttatctgctttcccttgaaaaattggctcaattaaaactacaagctgagttagccaaaagggaaaatcaagctctgttgataccgctaagtttaacccttgatgaacagcaaacagcgtcttggcaacaatcgcaaaccgctttggcagacttgggttttgatattcaaacaaaacagtggcaagggcaaactcgccttaccattcaaaaagtcccaacttgtttacgcgaacaaaatctgcaacaactgctgtttagtctattcaatcaacaagcggtcgattgtgccgaattttttgcaaaaaatgcgacttatccaaccgctagcagtttgagtgaagcggtggcgttgttggcggaggttgaagtgctgccgagggggaaagcgatgttagaggcgttgagagttgaagtggattttgaagaaatactaataaatctttaagaaaaaatctctatctactccatctatacccataaggtatattgaatgattttcgagcttgggtgtataagttaccatgaaaagttttcataatgtttgtgaaaattatgaacttgcataatgttgttgttttgtagattatacaactagccatttagacggctaaacgtctaaataaaagaaatatcaaatctatcaaaggagaacatattatgacaacattccacatcttaggctttccacgcgttggggcgaaacgtgaattaaaatttgcacaggaacgttactggcgtggtgaaatcgcagaacaagatttattagatttagccaaagccttgcgtgagaaaaactggcagcaccaagcggcggcaaacgccgatttcgtagcggtgggcgattttaccttttacgatcatattttagatctacaagtagcaacgggagcaattcctgcgcgttttgggtttgacagccaaaatttaaccctttcgcaatacttccaactggcgcgcggtaacaaagatcaatttgccattgagatgaccaaatggtttgataccaactaccactatcttgtgcctgagttccacaaaaacaccgaatttaaagccaaccctgctcactacgttaatcaaatccgtgaagcgaaagccttaggtttgaaggttaaacctgtgattgtcggacctttaactttcctttggttaggcaaagagaaaggcgaagcttttaatcgttttgagttattaaacaaacttgtgcctgtttaccgtgaaattttaaccgcacttgcggcggaaggcgtggaatggatccaaattgacgagccggctttagctttagatttaccggcacaatggttggcagcttatcaagcggtctatgcggaattaagccaagtgaatgcgaaattgttattagccacctattttggctcagtggcagaacacgcagaattgctcaaaggcttagcggtggacggcttgcatttggatttagtacgtgcacctgaacaacttacggcatttgaagattaccgcaaagtgctttcggcaggcgtgattgatgggcgtaacatttggcgtgcgaacttaaatcaagtgttagatctgcttgagccgttaaaggcgaaattaggcgagcgtttatggattgccccaagctgttctttgttgcatacaccttttgatttagcggtggaaacgcaattacaagcgaataaacctgaactatatcaatggcttgcctttacgctacaaaaagtcgaagaattgtcggtaattaagaccgcacttgaacaaggtcgtgtagctgtacaagcacaattagacgcaagccaagcggcagctaatgcccgagcgacatcaaaagagatccaccgtgcagaagtagcggctcgtttagccaacttacctgaaggggcggatcgccgtcaatcgccatttgcagaacgtattgcgaagcaaaatgcgtggctaaacttaccgcttttaccaacgacaaatatcggttcattcccacaaaccagagaaatccgccacgctcgtgcgagctttaagaaaggcgatttaagccttgcggattacgaaacggcgatgaaaaaagagattgaatatgtggttcgccgccaagaagagttagacttagatgtgctggttcacggcgaagcggaacgtaatgatatggtggaatatttcggcgaattgcttgacggctttgcctttaccaaattcggttgggtgcaaagttacggctcacgctgtgtcaaaccgcctgtgatttatggcgatgtagctcgtcctgaaccgatgacggtgcgttggtcgcaatatgcccaaagcctcaccaacaaagtgatgaaaggaatgctgacaggacctgtgacgattttacaatggtcgttcgtgcgtaacgatattccacgctcaacggtctgcaaacagatcggcgtggcattgtcggacgaagtgttggatttagaagcggcagggatcaaagtgatccaaattgatgaaccagcaatccgtgaaggcttaccactcaagcggtcagattgggatgcttatttgcaatgggcgggtgaagccttccgtttaagctatatgggcgtgcaagatgacacccaaatccacacccatatgtgttattccgagttcaacgacattttacccgcgattgccggcttagatgcggacgtgattaccatcgaaacctcacgctccgatatggaattactcaccgcctttgccgatttcaaatacccgaacgacatcggcccgggcgtgtacgacattcacagcccacgcgtacccaaagcggaagagatcgaacatttgttgcgtaaagccttgaaagtggtgccaaaagaacgtttatgggtaaacccagactgcggcttaaaaacccgtggctggaaagaaaccattgagcagttgcaagtgatggtggaagtaaccaagaaattgagggcggagttggtgtagttaatatttatcttaagctatggaaatagtatagatatctttgtcaacaatctgaaattagccctattacttgggctaatttcggatgtattccttgtaatgtacattgcatctgaatatatcttccaaaataacaataaatttgtcctattctttaccataaaattttctgtattttatttactgtgtataaaaacagtgatactatatactcatacagtgcttcgtatgggtattttcttatgctaactcaattaaccatcaataattttgcaattgttcgtcacctaacccttgaattaaatgaaggaatgtctgtaattacaggggaaacaggggctggtaagtctatcgggattgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgcttggcttatgcttaggctatcgttctgaaagttcgatgatccgtaatggtgcagataaagcggatatttcggcgacattttctatgcaacctactagccctgcctatttatggttaaaggaacacgagctactcgatgaagataatccacaagagtgcattttacgccgtatgattaaccaagaagggcgttccaaagcctttgtcaataatcacccaatccctgtttcacaactgcgagagcttgggcaataccttattcatttgaatggtcagcacgctccacaactcttgctgaaaagtgagtatcagcttgaagtggtggataattatgccaatttacacccattattagcggaaatggcaacgcaatatcatagttggcgaaaattgcataagcaggtgaaaaatttccatcaacaatgccaagagaatgaagcacgcaaacagcttttgcaatatcaagtggaagaactcgatgaatttgcgattaaagaaggggaatttgagcaactagaagaagatcacgctcgccttgctaattctgagcaattaacggaactgtcacaatctgtattgaatttgttaagtgatgataatgccaatgtagatacaatgctctatcgtgctattcgggatttagaagagctagtcgaagtcgatagccaatatcaatcggcattagaaatgctcaatgaagccttaattcaggtacaggaagccagttccgaaatcaatcatcttgccaataaaattgagcaagatcctgagctattaaatgaattagatcaacgcattagccaaacaatgcaactggctcgcaaacatcacattacccctgataaactatggcaaaaacatttaggcttaaaacaagagctacaaaccttattagattttgcagagaatgaagaacagttaattgccgatgaacaacaagcctatcaacaatgtgttgaattagcagaaaaaatttatcacaagcgggtagatgcagggcaaaaactgtcagcccaagtgaccaaacagattaaacaattagcaatggaaaacggcgaatttttcattgatattcagcataatctcgacaaattatccgcaaatggggcggatttcgttgaatttaatcttcgcagtaacttagggcaaaatgcacaaccattagctaaaattgcatctggtggcgagttatcacggatttcccttgcggtgcaagttttaacggcgaataaactttcaacgccgacgattattttcgatgaagtcgatgttgggatcagcggaccaactgcaacggtagttggcagattattacgccagctaggcaaaaaatgccaagtgttgtgtgtaacccatttaccgcaagtggcaagtcacggtaatcatcattttaacgtgcaaaaacaagttgaaaataatcaaacagaaaccaaaatgagcttgctgacaccaaaagaacgagtaaaagccttagcccgattgttaggaggggaaaaaattaccgatgctgtgttagcgaatgctcaggaaatgttagatttggcagaacagggttaattcagtggaatacaaaaatgcctttgttaaagaaaacaaaggcatttttttaacaatagaaactattatttgtctttggtagcagttgcaccaataactccttcccaattattttgaggggtatttggtgttgaatcctcctgtttagcttttcctaataaaatctcgccacttttgccatataaaccaccttcaaattgccctgcgactttttttggtttacccatcaaatataaacgagtgaaaatagaaccattttcactaacttttgtttgattagtagttaaattattcccattcacatcataaatattaattaaaattgatttattcatatgtttataggttgctgtaacatcagcctctttagcttgttcaggagcatcgttgagagcatagtacatttttccttgataagataaatcgtgagttggaagagttttggcttcttctctcgcggtcacttctagtaaagccatatatttgcgttcaacatctttctcaccaggcctatatggatctggttttgttttacttaatgtcgcataaccataatatccaaccaaatttccatcggcatctcgtaacgtattcattttactattatttgaattgctaccattgactggggctagcttgatttctttgccttcaagggtaatactcacccaattgctcgcatcgtaataaccaccatttttcgagaagccctgccaaatatcttgatcattcaatttttgagagggaggctctattttttccttagattgcttaccaacaattggctcttttatttgcttatcctcttttgcttcgggagctttgctagcattatttttatccaaagattgggggttattttcacttacttgttgattagtaataggattttctgttttatctacagcttgctgatgaccaccacttgaaccaccgccaccacaagctactaagatgcaactagcaagtaatgtaatactaagtttttttgttttgttcatatttgtctcctcataaattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggggatttcgttgatcataacccaaccgttaagaatttagcacttgcattcttaatcttaatcggtatcgcattaatgggtgaaggctttaatatccatattccaaaatcagcgatttacactgcaatgggcttctcggtgattgtagagtttatcaacattaaaatgcgtaaaaaccaagaaagatatcggaaataaatcataaaagctctccagattaggggagcttttgtattattaatatatgcacttcctataagtaggtatacattaattgcaagaaaataaaagaattaaactatgttaattaaattattacgctttatcatagcaatcacaatactatttttactactttacttgggtaaggtgctcagcccattaataccgattcgtattcctgaaagcattctaggaatgttaatgttatttattttgtttggaaccaaaataatcaaagtgagcagtatcaataccgagatgtacaatgttgaatacaattaatgagatacacacgtgatttatataaatgttgaatttgattaccctgaaatgctaatgcagtttcaactcaatgtaaaaaaaggggaacgcattgcggtgattggtgaaagtggtgcaggcaaaagcaccttgcttaacctaatagcaggttttgaaaaagcggatcgtggggaaattttactcaatggggaaaatcattttgccactgaaccagctcaacgtcctgtatcgatgttattccaagataataacctttttccacatttaacggttgctcaaaatattggtttagggctagtttctcgtttgcattttgatgctacacagatgcaacagattacgcaaattgcagagcagatgggcattgctgaactgttagaacgccgttcggatttattatccggcggacaaaaacagcgtgttgcactagccagaacactgcttagagataaaccgattttgttgttagatgaacctttttctgcccttgatccacaaaagcgaatggaaatgcaacaactggttgtagaattatgccaacagaaacagctcacgttactgatggtgacacatcaagtggaagaagtgagcaagtggtgtgatcaggtggttgaagtgaaacaagggcatttgatttactagtcaaaatctaattttttcagtaagattaaagattattttatatcggatttaaaagaggttattgtgccaaatcgtgattatgctgttcgctctaaagccaaaaaaggtggaaatactgcactgatcttagcagtgattattttattattgatgggaagtggctttgttctctggtttttaaaagaaagcaatccaaccacgcctgtaatgccgacacaaatggcaccatcacagcaacctaaaagtaccttgccaaccccaccgcaagaagtatatagctacattcgagatctagaaaccagagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttcctgtggataaaaattctaaattggcacaattaaccaaagagcaagagttggcaattcagaaacaaaaagaagagcagcagttaagccaaacagcaacatctgatccagtcgcaaatacctcgacagcaacagaacaaaaacaagagcaacaacaagaagttagtgaagaaaaaccaaagcaagagcaactcccaaaaacacaagaacaggcaaaaaatattacaacagcaaagcctgcttcagagcagcctaagaatgtcggaaaatttggtttacaatgtggtgcatttaaaaataaagctcaagcagaaaatatgcaggcccgtttagctatggctggttacaatgctcgtattaatagcaatggtgaatggaaccgcgttgttgttggtccagctggagatagagctaaagcaatggcggcgttatctaatgctcgtagtgtagcagaatgtgtcattattggtatgtaattaaaaggaaacaaaatgcaatttaaagattatttagcgactttccctagcattgaacatttgtcaggcttatctatattggatagacaaggaaatatcattcaccatattcccgctattgaaggtaaattaggttcattaaaactgtataatgcacttgcagaaagatttagtcagcagctgaatgttaaatctgctcagcaaggaattatttggtttgctgagcatgttgaagatgcaactcaacatccagggaaacacccgaatattgacttattatttaatattgttgaacaaaaattagagttgacattaaaacctattactaatggataaaaacttatcatttatgagttacttaactttacagctcttattttcataaagttgtagcaggtatagtagacaagcattattgcacagaaaacttcaccggcaccgttagcgatgtagggaaacctgctggaggaggcgagtgcatttttgtgctttgagccgctttcattgctgccgcatccaagttgctattccctgacgaattaatcacttgaacattaattacttgccctgatgacgataactggaatgataaggttactgtccctgtttttcgcatcattttctctctttgaggataagcattgttagctctttgctgcaacgtccgttgtaattgagctttataagcgttaatttccccaccacttgctgagccactatttacagtgccactaccttttggtgagccagtcacaataccctcttgattttttgcaccttgcaccgcactcggagttgcttttgctacaacaccttgtttagcttcagcacctttttcaatagcttttactggaggtttctctttcggttttggcttttcttttggcttnnnnttttcttttggtttttcctttggctttggtggctctggaacaggttcaggaataggctcaggctctatgacaggctcaggtttcttaacttcttcctcaacgggttcttccgctgccacagccacttgttcttgctctaaacgtgccgccaacatttccattgagatactggaaacttcctctgttgcaggtaatggtttttgagtatggataatcccaaacaccgttgcaaatagcgtaccgtgtaaggtgagagagccgattaatccgatacgggagtgacgttttttcattacttactgttctcttttttcgtcactattgctacatttttgatttcatttgcagccagaagatcggttagctcaacaaatttttcaaaggcaacggtcgcatctactttcaaggtcaccttttggcttttatcccaagtcgatatttctgcatttagttcttctttagtgatcggtttatcattgtagaaaaattcattattttcagtaatagtgagcagttttgctaattcatcagccttcattgcttgtgtagtagaggctttcggtacatttacttgaattttaccttgcgagataaaagaggcagtaactaatacaatcgctaatagcaccaacataatgtcgatgaatgggataatgtttatttcatcaaattttttcattctatcctcgtcgcttgtcaatttttagcggtaagtgaccgcttatgctttagctttgcgagcttcaagggcttgccattttaatttgttttcttcgactttacgtccaaagccgttataaaacatcattgcaggaatggcgactaagataccgacagcagttgctttgagggctaaagagagatgcaccataatagaagcagcgtcaatatccccaccggaatgcccaagttcatagaatgttaataagataccgataacagtaccaagtagtccgatataaggggcgtttgagccgatagttgagatcgttgtgaggttagcagtgagatcgatttctaactcttgcaatgtttcgtaatctttgacttctactttcttataaaatagaactcgttcaatgattttggcaaataaaatcacactcattagtcctaataaaccaagaataatatagtcgatgtagctttgtaaaaattgaaatagttgatccattgaaaagtcctatcatataaagaaaaaatgcgtatagaattacgcatttataatagttcctattatataaaagtgagttgaaatttcaactgctgtaatagcttattgtttatttacaattttgtgtttaatgctatatttcctcgatttcaatagaggaaataatatggaagaaacatttacagaaattaccccacaacaagcgtgggaaatgatgcaaaatgaagacgctgttttagtggatattcgtgatatggtaaggtttagtcatagccgtcctcaaggtgcatttcacttaacaaaccatagctacggcaagtttttagatgaatatgattatgatgaacctgtgattgtgagttgttatcacggggtgagtagtcgtaatacagctcaataccttgtcgagcaaggttttgagcgtgtatatagtgtcaaaggcggttttgagggctgggttagatctgaattaccgattgaattaggctactaggctaacaagtgcttggattagatgggaagaattaaacatatttcataagagagaacaaattatgtggaaagaaatcttacttaattacggtatctttttgctggaattattgacggtctttggcattgtcgccgttgtgataatgctgattttagaaagtcgtaaacagccagaatcaggctcaattacgctgactaatttaactgagaaataccaagaacaagaaaaagcacttgcaagtgcctttttaagtgaagctgagttaaaacataaagaaaaacaagagaaaaaagcagaaaaagagaaagcgaaagcagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagagaaatcccgtttgtttgtcttgaactttcaaggggatattcaagcgagcggtgtatctgctttacgcaaagaaattgatgccgtacttgctttggcaaaaccagagaaagatcaggttttgttaaagctagaaagtccaggtggcgtggttcacggttatggtttagcggcttctcaattacaacgtttgaaagacaaatccattcctttgactgtggcggtagataaagtagctgcaagtggtgggtatatgatggcgtgtgtcgctaacaagattgtatctgccccttttgctgtaattggttctgtcggcgtggtagctcaagtacctaatattcaccgtctattgaaaaaacacgatattgatgttgatgtgatgacagcaggtgaatacaagcgaacagtgacatttgtgggtgaaaataccgaaaaaggcaaacagaaattccagcaagaattggaggaaactcaccgcttgtttaaacaatttgttgctcaacatcgtcctcagttagacatagaaaaaattgcgacaggtgaacattggtttgggcaacaagcagttgaatttaaccttgttgatgaactctctactagtgatgatctcattttagatgcggtaaaatcgcaagacgtgattgaagtgaaatatcaacaaaagaaaaaattatcgcaacgtgtgggagagcaaattgagtcgagcgttgagaatgttgtgatgaaatgggtgaataaatctcgttcaccacttttatagataacaattgtttgattaattttaaattttcattaaattgtcgaataaatagacttcccaaatggcgaaaaaatgcgtattatacgcatccctgagttagtaggcgataatgatgctgaacactgaataaaggttgtgaagtacggttttacaccgtactttttatttggatatcgtttaggttaaatttgtactaaaaataatcaatggataagtcgatgcgaattggtcaatatgaaataaaaaaccgtattttcctcgcgccgatggcagggattacagatcaaccttttagaagactgtgtagccaattaggtgcaggtttaactttctcagaaatgatgtccacaaaccctgatgtatggcataccgaaaaatcgaaattgcgtttatcgcatcatcacgaaatcggtattaatgctgtacagattgcgggatctgatcccactgaaatggcagaagcagcaaaaatcaatgtcgcttacggagctgaaattattgacatcaatatgggatgcccagcgaaaaaggtgaacaaaaaaatggcaggctctgcccttttacgcgaacctgatttagttgcccgtattttagatgcggtcgttaatgctgttgatgtgcctgtaacgctaaaaattagaacaggttgggatcctgagaaccgaaattgcctagaaattgccaatatagctgaacaagcgggtatctcagctttaactattcacggacgcactagaagttgtttatttgaaggtgaagcagaatacgacagcataaaggcagttaaacaagcggtttcgattcctattattgccaatggtgatattacctctgcggaaaaagcaaaacaggttcttgactatacacaagctgatgctgtgatgatcggtcgaggcagtttaggtcgcccttggttattttcggaaatcggcaagtttttcgagaaaggagatctcgtttcgacattatcacttaatgataagtgccaattaatgttacagcatattgaaaacctacatcagttttatggtgaagaaaaaggttatcgaattgcgcgtaaacacgttggctggtatgtcgaacagcttaaaccaaatgcaaattttagacgtacttttaatgcccttgattcgacgaaagaacagttaaaggcgttggaagattttgtaaaatcgattcgtgaagaatctcaataagttggataaaaggacaatgttagaacaacaaccgacacaaaacccattaacagtatcaatgttaaatgcacaagctcaacaagtagatagaccacttcgtgaaaatgtaaaacaagcggttcgtaactacttaagaaatttagatggtcaagatccaactgaattatatgagttagttttatctgaaattgaacacccaatgttagatatggttatgcaacatactcgcggtaaccaaactcgtgcagcgacaatgcttggtattaaccgtggtacattgcgtaaaaaattaaaaaaatacggtatgggttaatttttttgtaaactaaatcatatcattgaatctgcactttaatcgttaggtttagtctctaacatcataaagtgcagattttttatttatagagtgtgagattaagtcgatatccttctttgcgctatattttgcttgatttcattaataaagtgaaatatatagaataatgtcattactactaaggcagaaaaggattaacattaatatactgcgaaatggtaagttcgtaattttttagcaaaaaattaaggaaatctcaccgcttttttgctatggtacgccttaattttttctaatgagaacgaaacaatgaacgacgctcaacaatctcaacaaccacaatcagaaaccacccattttggctttaaaaccgttgctaaagaagaaaaacagcagttagtcgccaatgtattccatagtgttgcaggaaaatatgatttaatgaacgatctgctctcttttggtattcaccgtgtgtggaagcgttttaccattgattgcagtggggtgcgaaaagggcagaaagtgttggatttagcagggggaacaggggatttcaccgctaaattttctcgtattgttggcgaaactggcgaagttgtacttgccgatattaacagctcaatgttggaagtcgggcgtgaaaaattgcggaatttgggcgttgtcggcaatgtgaattatgtgcaagcgaatgcagagtgcctgccgtttgcggataacacctttgattgcattgtgattagcttcggtttgcgtaatgtcactgataaagataaggcgttacgttcgatgttccgtgtgttgaaaccgggcggacgtttgctggtgttggaattttctaagccgattatcgatccgattagccaagtttataacttctattcctttaatattctgccgaaagtgggcgaagtggttgtcaatgatgccgacagttatcgctaccttgccgagtctattcgtatgcacccgaaacaagacgagttaaagggaatgatggaaaatgcagggtttgaaaatgtcggttattacaatttaagtgctgggattgtggcattacatcgtgggtacaaattttaaaaatgaaaacgttattacaacagttgatgttaccgcaatttgcgttaggggcattggaaacagcgtttaatcatttgattgaacgttcaccccaaacatcgccgatgttacgcaaacttgcagggaaaattcttaaaattcagttaaatcaaccgaatattatactttttgtgattttcagtgaaaaccgtgcggattggctggcgaattatgagggtgaagttgattgtgcggtgagccttgatgcgacagctctcccaaaactggcggataaaagtaaactgagtgagttgattaataataaaacactgattttgacaggcgatattcaagtattacagcatttttcacagttacttgacgagttggaaaaagatcctgcggaattgctctcacgttttatcggtgatgtactggctcaggcttcaacggacttcgccaaaggtatttttaccaaggtgaaaaatcagtttgtgcaagacagtcagcaccttgtcgataacttgacgaccgaacgcccagtgcttgttcatcgtttgcaagtggttgatttttgcgatcaggtaaaagagttggaacaacaagcggagagattagagcagaagtttgcaaaactagcattaaattagaatttattttcccttcccccgtttacgagggaagggaataagttggaaaaaaaggaaataaatgaacatcaaaaacctgcgtcgtctttatcacattattcacacctttcttcgctatggtattgatgaggtgattccagatattccgctaacacgggggatccgttgtgggcggaagtcgttattttgggtaaaaaatcaatatccgaatgagcctttcggcgtgcgtttacgccttgcgttgcaagagcttgggcctgtatggattaagctggggcagatgctttcgactcgtcgagatctgtttgaacctgagttggcagatcagcttgcgttgctacaagattctgttgaagcttttgacggaaaactggctcgtcgtttaattgaagaggctctaggcgataagttggaaaagtggtttgatgatttcgatgaaaccgctttggcttctgcgtctattgctcaagtgcatacggcaaaatttaatcaaaaccaaccgcttgcaggtaaagaggtggtattaaaagtccttcgcccggaaattgagcgtgtgattaaggacgatttagccttgatgtaccgtttggcgagttggattccacgtttaaataaagagggcagacgcttacgcccggtggaagtggtgcgagagtatgaaaaaacgctgttggacgaacttgatcttcgcaaagaaatggtaaatgctatccgcttgcgtaacaattttgaaaacagtgaaatgctctatgtgcctgaaatgtatcaagagttttgccataaaaatgtgattgtgatggaacggatttatggtattcctgtagcaaatattgatgaactaaaagccaacggcactgatatgaaattgcttgccgaacgtggtgtgcaggtgttttttacgcaggttttccgtgatagctttttccacgccgatatgcacccgggtaacatttttgtgaacccaaatcaccccgaaaatccacaatatatcgggattgattgcggtattgtcggcaccttaaatcagaacgataaacgctaccttgccgaaagttttgttgcctttttcaatcgtgattatcgccgagttgcgttaatgcacgttgagtcaggctggacaccggcagataccgatattgatgcttttgaagaagcctttcgagaagtctgcgaaccgatttttgctaaacccctttcggaaatttcgtttggacacgttttgttgaatttgtttaccgttgctcgtaaattcaatatggaagtacagccacagttggtgttattgcaaaaaacattgctttatattgaaggattaggcagacaggtttatccccagttagatttatggcaaaccgctaagccgtttttgcaagattggttgaatgaacaagtgggctttaaggctatgtggcgagatctaaaacagcgagctccgcaatttagggagcattttgccgagttccctgaagcgatgtttcaagccttgcaacaacaaaaacagattaattttcgtttaaatgaaatcaatcaaagcctgaaagcacaacgtaataacacgggcttttcccgtttgatgattttaggcatagcgattgcgggtacgttttggaagtttgaaatgttgccgttgtgggtgagtgtgccgttgttagttattgaattccgtatattaatatggtgtatgagttttagtaataacagttactcataatgttttcctataaataaagatattaagttagatagagagctttttaaagattttgttatgttttatgtttgtccttgccaatcaaaactagcatatgatgaatgctgtaaaccatttcattttgctcaaaaactgcctattacagccgaagaattgatgcgttctcgttattctgcttacaccaaagttaatattgactatatagttagaacgacactccctgctcagcaatcattgcttgacctaaaagcaataagagattggagccaaaagactcagtggataggtcttgatattatttctaaccaagaaaatgtgactaaaattcatagtattgttgaatttagggcttactttaatacagaagatggtgtgcaaattcatcatgaatgttctctttttgtaaatgtagatgatcgttggtatttttttgatccaacagttcctatgcctgctatgaaaaaattgtgtatttgtcgatctgggaaaagattcaaggattgttgtggccgttggatatgattcttcgagcaatcctatttttgtaactattttgtggagaatgcactagatttttaaaattgctattaatacttgtttataaaagataattggcacacgtccccgtaaccacacggggatacgattttcctgccaaatctttttcatctcttctcgatggtttttgccgtaatactgcactttgcttggagagcggttggtcaggcgaagtggggtttgttgtaacgtttctggcaataacaagcggtgagatttgcctgatattttgtaaataatctctgtgccgttgcgttgaacaatgccaatagaggtgggcagttgaatttcttcactttgtggtggcagttccaagtcaaaatcatctgtctctgcttgaataggggtaatgaagatctgctgttggtaacggcgaataaggtgttgttcaagtttgacctgcggatttttatcggctcttgccaaaatgagatgttggataatctgttccagttgagccacgcttggcattgcaaggtgagcctgtgccagccaaaaacggacaagctgttgttgctttaacaaagaaaaatgctcaaagcctgtgatgtctaaaccgccattttgtagccgactagccagttcggggtgtagcaattcttcaatcagttgttgttgctcggcacaatgctggcttgagcgtgccaccatttgattaaactgttgccaacgttgattgagcaaaggtaacgccgtttgacgtaggaaattgcggtcaaaatcggtattgaagttgctttcatcttcaatccattccagttgatgttgttcagcataagcgagaatgtcggttttattgaagctgagaagcggtcggaaaatcgcaatattttgcaaaaaactgaccgcttgcattgcccctagtccttgaataccacttcctctttttaatgcaaggaaaaaggtttcaacttgatcgtcaagatgatgtgcggttgccaatatttcattccgttgaatatgctgttgaatggcttgatagcgtgctgttcgagcattggcttccagcccttgcttgccttgtacttgaaccttgcagacagtgaaaggaattgcccactgttcacaaagctgttcacagaatgttgcccagctatctgcatttgggtttaagccgtgatggatatgaattgccctgagtttaaggttaagggcttgtcgagcctgtgcgaacagatgcagtaagactaccgagtccaccccaccgcttaaaccgatgaagaaagcggtctgattagggcaatgctttgcaagttgttgctggaactgttggtacattgccgtgcctatacttgtagccaaaaggtgacaggcccatcattctgtaagctgacctgcatatcggcggcgaaccgtcctgtttggatatggattttgagtgccgcttgctgatgaaaatagtcgtaaagtgcttgagcaagtactggggttgccccacgagagaagctagggcgtagacctttttgggtatcggcggcaagggtaaattgggaaacgactaataaacttccccctgcttgctgaacgtttaggttcattttgccttgttcatcggcaaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgatagttcaagactttttccagtaagcgatctgccttagcctgatcgtcaccttgctcaacacctaataatactaatagtcccgttgaaatttcgccgacagcctggttatctacttccactttcgcccattttactcgttgaattaatccgatcattctctgtcctccgttaatggatttgctaattcgccagccttgatcatttccatatcttttaatacagaagcaaactgcccccctagtaataccactcgccagcttaggtggatccaaacaatcataatcggaatcgtggctaacgcaccataaattgcctgatatgatgggaaagtggtgatataccagatgaaaatttgtttacccagcgtaaagaaaactccagcaaataaagcccccaccgcagcgtgtctaaacttcacttgggtgttaggtacaataagataaaccaaggcaaacagcaaccaagttaagacaaaaggaataaatttaagcaggtggtggctaaaagaaaacagcccgtcttggctaaacatttccaacgagaaaatataagagctgatggcaatgctcgctccagcaaaaatcggggcaaaaatcagcacagccaaatagacaacgaaagagagtatcactgaacgttttttcgtattatgccaaatttcgttaagggcattatcaatgcttgaaatcaacatcaccgccaccacgactaaaccgatgatactgatgatccccattttctttgagttatcgacaaacatctcgagatattgctgaaccatattccctgcacttggggcaaagttatcgtacaccagctcttttaactgtgcggtggcttgttcaaaaatcggtaatagcgtaaacaccgaaaacaccaccataatcagaggtacgagagaaagcaacgtggtataagtcagataccctgaatagaccgcaattttgttttgttgaaagcggtggataaagagtttaaaaaagaagataagatttttcatattatttccccttaagatggggaagtttagcatagcttaatggcttgtggcatattctgttggggttttgtttgcttgtattaagttctctcttaatctgtggtcaattcgacatgcctctttagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatatggatatttccattctggtcttgtgttaaatcatagttcactaagcccgtattgttcaccaaaatctgtttgctatttggatcaattaaagcaatattaataccttctctttgaataagataacgagttacatcaccgacacgggaggttacaaaacttagctcttgataattagcaatagctgcttttaacgatttcaccgctcgatgttctgcggtttctggttctgttggtttaacctcgcttacagtcgctgtttcagttgaagctacgcttggagtaggctcaggtgctggctctgcaacttcaggagttggcacagcggtcggttgctcgcttgtttctgcaacagcttcttctgttggagggacttcacttacagtctctgtttccgatgtctctgtatttgatgattgagcatctacatctgtttcttctggagctggttctgtcgtgactgtactcgcttcgttagtattctcagctactgtctctgtattggttgaactattattttcagttgcagtagtcgttgttgtactgttactaataccacaataactagcatcagctcccggagctaaacttaatttacaatcctctcggttagtggtgtctttataagtaccattatttcgcgtttcatcaatactcacataagtaatgctgtaaatatcgtacacatcggtgacatatttatttccatttggaacatagtaactataaagaaaacgaaaaatttcattacctttattatcaagtacataatcccctgtcacctcaaccattttaaggtttcctgcctgatctgctacagagtcactgatataaccttttttaattttgccagttttttcatctacctcaatgccccataaagtcacagtatgtgtccatgatgttagcgcggcaacaacgtttccagttttgaagttttcaaccaatgattttgtaactaaagctgcattagagtcgtaacgctcagtccaaaatggaccaccactgatttttgttggcccacgctgtgcctcataagaagttttcgtattatgagtttcatataacttaacagtgggagcaaaatcctcaaagaaatattccattccacgaaatgggtataatcctccctgtatgtttggatatttcttatttaaccattttgaaatctccttattatcgtttggtgtattgggattaaataaaacaggggtttttaattctcttttccaccaaccaagcatatttcctgcaacagctccccagcattggttaggatattgaaaatcagcagtccaacctttttgcttatcaactccacttgcccagtagacatcgtctgccaaaacattaacagaggatgaaagtagagcagttatcaaggccttcgaaaaataaggcttcatattatgatctcctttaaatttatggaaagaatactgaaattatactggtaggaaaaatttgaatgcttttataatagctcattgattaacgatgagaaatacaaaaaaccatcagttaaatttcaccgatgggtgattgtaaactttttaatcagataaaactttgagcaagctcaatatatggttatgaaaatgtcgatattatctaccgcctatttcatcacgctactttacattgctctctctgtatcgcacgatacccaatatctcgacggtaaaaacgcccttgccactggatctgttcagccagttttaaggctttttgctgtgcgtcagatacggtggaacctaatgcggtggcacagagtacacgtcctccttttgtgactaatttcccattctgctggctaacacctgcgagaaagaccttttcatcagcacaataatctgtcggaacccccgtgatttcatcattttgacgataatctgcaggataaccttcggcagcaagcacaattcctaacgctgcttgttcacaccattttgattgtatctcgtttagtttgccgtcacaggcttttagacagagttcgacaagatccgactccaatcgcatcataatcggttgtgtttcaggatcaccgaaacggcagttaaattcaattaccttaggttgtccatttggcataatcatcaagcctgcatagagaaaacctgtatattcattattttcacttgccataccacgcactgtcggataaataatttcttgcatcacacgttgatgaacatctggagtgacgacaggggcaggggaataagctcccattccgcctgtatttaagcctgtatcgccttcacccactcgtttatgatcttgactggttgccattggctcgacatttttaccatcgaccatcacgataaaactggcttcttcgccagctaaaaattcttcgataacaacacggctaccagcatcgccaaacgcatttcctgaaagcatatctttcactgcttcttcagcttccgccaatgtcattgcaacaatcactcctttaccagccgccaaaccatcggctttaatcacaatcggggcatttttttggtgtaaataggctaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaggtttgatattctgctgttggaatgttgtggcgagctaaaaagtctttggcaaaggcttttgacccttctaattgagctgcagcttgagttggaccaaaaatttttaatccagcggcacggaatgcatcaacaacgccgataactaaaggtgcttcaggcccgacaatggttagccccacctcattttctttggcaaaattgactaaagcggtcagatccgttgcagaaattgccacattttcaattccagcttcaagcgctgttcctgcatttccaggcgctacaaaaaccttttccgctaaaggtgattgacgaactttccacgccaatgcgtgttcacgaccaccgttgccaataatcaaaatattcattgaaattcccctgtaaaaaatcgctaaagatctgaccgcttgcaaaaagcaaacgtttgcgtagtgtatcggatttagtgatgaacaggaagcattatttattgagaattagcattaatatctatctataatcatatatccaacattctatgctaaaatctctcctattattttttacagagaatcaactatgacaatgattaaaattgcacaacaagccaaacaagcgagctttgagttagtacagtttggcaatgttcaaaagaaccaagccctgttcgcaattgccgatgcgttggaacagcgtaccgaggagattttagtggtcaatgcgaaggatattgattatgccaagtcgcaagggatttcagaggcgataatcgaccgcttgttgctaacacctgagcgtattcgtgggattgcaaatgatgtgcggaatgtggcgagccttgccgatcctgtcgggcaggtgattgacggcggtgtgttggatagtgggttgaaaatcgaacgccaacgagtgccgttaggggtaattttgactatttacgaagctcgtccgaatgtgaccattgatgttgcttcgctctgtttgaaaacaggcaatgcggtgattttacgtggcggtaaagaaacgaaatttaccaatgcaattttggttgaagtcgtgcaatctgccttagagcaggctggcttaccgaaattagccgtgcaagccgtcactgatcctgatcgtgcattattgctcgaattgctcaagttggatcagtacattgatatggttattccgcgtggtggagcaggtttacatcagttctgcaaagaaaactcgactatcccagtgattgtcggcggtatcggggtgtgtcacctgtatgtggaagccagtgcggatttagagcgttcgctgaatgtgattgccaatgcgaaaacccaacgcccaagtacttgtaacaccctagaaaccttgttggtcgataaggcgattgcagatcagtttttaccgaaactcgccgaacatctttgcaaattgaaagtgacattgcatagcgatgatttttctgaagatctgcagaaaaatccgcaaatccaaccgcttgaacaagcaaaattacgtcaagagtggttgtcgttagacttaagtgtggtggttgtagatggtattcagcaagcgattgagcatattcgtaactatggtagccaacactccgaagggattttaaccagtaactatgctttagctcgccaattcgttcagcaagtcgatgcggcggcggtatatatcaacgcaagtactcgttttaccgatggagcacaatttggcttaggagcagaagtggcggtcagcacacaaaaactacacgcccgtggacctatggggctagaagcactcacgacctataaatgggtgtgtgaaggggattatttgacgagaaaatagtgtctcaaagatataaaaaacgtatatgaaatataaagagattcaatatttttaagctatactacataatatagggaatcttagatatatcttgcgctggtacaaagtgttaagcgctaaaaaaatttacaatgattcgtcaatacaatttaaaaacacatccaatgatttgaaggagaacataatgaaaccttatctttcgaagatcgtaatagcgacacttttttcttcatctgtacaggtagttgaagctcagacttattgggcaagtggagtcaatcaaaatagtggatggactgctgatttacaatatccaaatcagtgttggggcgctgttgcaggaaatactctcggatggtggaaaagtagagtaaaagcgcaagtagaatttaacgaggatactcctaaagatagcaaagccatttcaggatggatatataaaacttatccgcatatacagggtggattacaaccatatcgaggtatggagtattttttctctcgttttgcatcaggagtaaaattatacgaagaacataataaaaaaacgtattatgaaagtgagagaggtccaacaaaaattagtggtggtccattctggacggaacgttatgactcggatgccaaattagtcactaaatctttaattgataattttaagacaggaaacgttgttgcagcactcacttctcagcaccataccgtaaccttatggggaattgaagttgatggggatggtaagataaaaaaaggatggattagtgattctgttaaggataaagctggaaatcttaaaatggttgaggtggtaggaaattacgcaaaagacaataaaggaaatgatatattccgttttctttacagctatgccgttgacggtggtcgcatgtatgtaacggatctttatgatatttatagtattacctacctcagtatagatgaggcaagaaataatggtacttataaagatacatctaatcgtgaggattgtaggttaagtttggctcctggtgtgtcagaaagtttttgttcaattaatagtacagcaactaatactacaaaggtagagaatgtatctactactagcaataactcaacaaatcttccaacaaaagttgaaaatagtggccattcaaatcaagccattaatgctgcatcggcatcagatgatactgtaagttcagcatccgaaaataatgattcggtaaatacaccggaaaatatcgaaaacagtaatggggtagatataggtaataattcgacagtatcttcggcaaatgttgaaaatagtagtaatgaggttagtgtaattaatacaccaaatacatcaagtctacctaacgatcaaggaactaaaaagattattgttgatagttcagaaagcaacgcaaaagatcctatcataagcaaagcgacagaatctttaacaaaggaaattaattcgtacccagaactaagttttatcactaagaatatgggagatgtaacattttatattgtgcaaaaagatggtgttgacataactttgattaatccaaaaactgaacagtcgttagttagtaataagggattagtaatctatgatttcaaacaaggccagaatggaaatatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgaaatccccaaatcaagctgcgatcaaagaagctaatgaagttacttcattgcatactgatcttaaccaygttgaaatgaacaatctyaataagagaatgggagagttgcgtggcattgacgccaatgcaggcgtatgggctagagtattaggcggtaaaggcagtagcgatagctataagcataaatttacccatattcagacaggttttgataaacaaagccacctttcaaatgcagagttatttactggggtaacrgtgacgcatacttcaacagacattgaaggaaaaatcggctcaacraacggcgatgtaaaatctatcggtgcaggcgtttatgcracagcgttatttgataacggcttttatcttgataccatcgctaaatatgtcaaaaataaccataaatttgactacgcatttaaagaaatgaagttagattttaaatctcaacratatmacacccattcattctatttgggtggtgaagttggctatagatttaacttaggttcaggttatgttgaaccacaagcggaagtgatttatgtcaaaaatagccaagctaatttagccgataacagacataaattaaccataaaagtctcaaatggactggttggtcgtttgggtgtgaatgcaggtaaaacttttgaaattggacagagcaaagcaaccgcttgggctggcattggctatcaatgggatattgcaaaacgcaatgaaattttggtagatggtataagtgctagcaatagcaaaaaagatgccagaatgttgatggacttgggrcttaatatcagagctaatgataagttaagtataggcttgagtttagaaggctctgyrtttggaaaatataatacggatttatctgttaattcyaatgtaagatactcgttctaacatcaatatagggtaatttaagaagatmaaacttaatctagctacgccccaaataattggcgtatgtkagcttgggtttgatcttttgttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaggaaaaacgtaaaatttcttataaaatcaatccgcctttcgatatatctacttttacagcaactcttttaggagagcattatgttgaaatccattcttgttgccctttttctttttttacttctgttacatcagcccaaacaatgaaactctataatcggttatgcaggcgtagagaaaaatttatcacaggcagagttttggtttaatcagatttctaatgaacgtaaaggacaaattatcgatcagctgtttttcccctatgaacataagaaaattcaagcagattggaaagatcagtaacaattcgggggcaaagctatattttgtccctgatttcaagtagaataccccctaatttttgtcagaaaaggaatgtatatgtccacgcaatttgtttacacgatgcaccgtgtcggaaaagtcgttccgccgaagcgtcatattttaaaagacatctcactgagcttcttcccaggggcaaaaattggggtgttaggtttaaatggtgcaggtaaatccaccctgttacgcattatggctgggatcgataaagagatcgaaggggaagctcgtccgcaaccagggatcaaaatcggttatcttccgcaagaaccaaaattagagccacagcaaaccgtgcgtgaagccattgaagaagcggtttcagaagtgaaaaacgcactcactcgtttagatgaagtctatgcggcttatgccgatgaaaatgcggacttcgacaaacttgcagctgaacaagctcaattagaagcgattattcaagctcacgatggtcacaatttggataaccagttagaacgtgcggcagatgcgttacgtttaccggattgggacgctaaaatcgaacatctttcagggggcgaacgccgccgtgtggctctttgccgtttattgctcgaaaaaccggatatgttgttattagacgaaccaaccaaccacttagatgccgagtctgtggcgtggttagagcgtttcttacacgactatgaaggcactgtggtggcaattacccacgaccgttacttcttagataacgtggcaggttggatcttagagcttgaccgtggtgaaggtattccttgggaaggtaactactcttcttggttagagcaaaaagagaaacgtttagagcaagaacaagcggcggaaaatgctcgtcaaaaatccattgctaaagagttggaatgggtacgtcaaaatccgaaaggtcgtcaggcgaaaagcaaggcgcgtatggcacgctttgaagagcttaactcaggcgaatatcaaaaacgtaacgaaaccaacgaactctttattccacctggtccacgcttaggggataaagtgattgaggtgagtaacctaactaaatcttacggcgaccgtactttaatagacgatttatctttcagcataccaaaaggggcaatcgttggaattataggggcgaacggtgcaggtaaatcaaccttattccgtatgctttcaggtcaagaacaaccggatagcggttcaatcgtaatgggtgaaaccgtggtacttgcctctgtggatcagttccgtgatgcaatggacgacaagaaaaccgtgtgggaagaagtgtcaaacggacaagatattttaactatcggtaactttgaaatcccaagccgtgcctatgttggacgctttaacttcaaaggcgtagatcaacaaaaacgtgttggcgaattgtcaggcggtgagcgtggtcgtttacaccttgcgaaattattacaagcgggcggaaacgtcttattattagacgaaccaaccaacgatcttgatgtggaaactttgcgggcgttagaaaatgcgatcttagagttcccaggctgtgcaatggttatctcgcacgaccgctggttcttagaccgtatcgcaacccacattttagattacggtgatgaaggtaaagtcactttctacgaaggtaacttctcagactacgaagagtggaaaaagaaaacctttggtgcagaagcaacccaaccacatcgtattaaatataagcgtattgcgaagtaatagtcaaatcagccatatcttttatggctggatgtggctatgtttttttaatgtgtgtcattgatatgaaataaagataattttaaggaaccttttatgaccaaacattacgactacatcgctatcggcggtggtagcggcggtattgcttccattaaccgagcggcaagttatggtaaaaaatgtgccattatcgaagcaaaatacttaggcggaacttgcgtaaacgtaggctgtgtgccgaaaaaggtgatgttctatggggctcaaattgctgaagcgatcaatcgctatgcaccagattacggctttgatgtgacggtcaatcgttttgattaccgtaaattagtcgaaagccgtcaagcctatatcggacgtatccatacttcttacaataacgttttagccagaaacaatgttgatgttattcgtgggtttgcaaaattcgtgaataagaataccgttgaagttgccttggcagacggtggcgtagagcaaatcacggctgatcatattttaattgcaacgggcggtcgtccaagtcgtcctgcgattaaaggggcggaatatggcattgattctgatggtgtttttgccttaaatgatgtaccaaaacgtgttgcggttgtgggggctggttacattgcggtggaacttgcaggagtattaaacagcttaggggcagaaacccatttattcgttcgccaacacgctcctttgcgtactttcgatccacttattgtggaaactttattagaagtgatgcaccaagatggtattcaacttcatactcacgctattccacaagaagtcgttaaaaatgctgatggctctttaacgttaaaattggaaaatgctgaagaacaaagcgtagattgcttggtatgggcgattggccgtgaaccagcaacagacgtgattaaccttgaggctgcaggtgtggcaaccaatgaacgtggctttgtgaaggtggataaattccagaataccaacgtcgaaggcatctatgccgtaggcgatattattgaaggcggaattgaattaacccctgttgccgttgccgcaggtcgccgtttatcagagcgtttattcaacaataggccaaatgaacatttggattacaaccttgttccaacggtagttttcagccatccgccgattggtactattggtttaacagagccaaaagcggttgagcaatacggtgcggaaaatgtgaaagtttataaatcttcattcaccccaatgtacagtgccgtaacacaacaccgccaaccttgccgaatgaaattagtttgtgtcggcaaggaagaaaaaattgttggcttacacggcattggcttcggtgttgatgaaatgatgcaaggttttgccgttgcaatcaaaatgggggcaaccaaagctgattttgataacacagtcgccattcacccaacaggctcggaagagtttgtgacaatgcgttgatttttatttaaggatattttttatgaataaactattattaatttttattgctatattttctgtaactgcctgctttgaacaacctaagaaggatattattcaagaaaagggagaagataaagctgatgtagaaggactaaaagcggaagattcaaaagttgagtcgccaaaagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcatcaaaagttgagkcaycaaaagttgaatctctaaaatctgaggtctcagaagcgggagcttcccaagtaaaaattcctgattctaagaaggatataacagaggcctcctcatcagatgaaaaggctggagctagacaatctatttcagttcaaaatgaacannttggcgcaagatatcaaggagccagaatctcagaaatctagtaaacctaaatcgttacaatatagtataaatagacatcaagaatcttcggggctatccccagaagaggctagagtaggttatcaagacacttcggggctatccccagaagaggctagagtaggttatcaagacactctatcagatgagggaattctctatctaaaaatgcaatgccgttatcctcttatgtctgagcaagagattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagcaagagattattaattttggttgtgggacaaaagaagtaaaagtagcagaatagtttaattgcaacaattaagcgttttcagtattactcaatcccagccatcttatgcgtctgaatacttaactgccaacggggtttgttcggacgctggttaagttttcctagttgggtgatggtttctaacatattcatcaccccattttcttcacaaggggaaaggtagtaacgctctgctttgatggtgctttctatctgctcacaaaacgctagcacatcaccgtccaccacaattctcacttcattcgcaaagggaatgtgatgtttcaaataattcttctgatataaccgcttggggctagtggcgatgtagtcaatttgtggcggaacgggttttaagccattggtttctattgcaataaaataaccttctgctttcaaggtatcgagcagatacgctaaatcgggctgaattgtcggttcgccccctgtaataatgatgttctttgcggaaaaacctttgaccacttgcataatatctgcaagggttttggtttcgtattggttgtaattggtatcgcaccagggacaagcaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagggacaagcaagattgcatttaccaaagcggataaaaatactcggcatacctgtgttgaatccttcgccttgaagggtttcaaagatttcgacaattcggtattctggatttttcattatcggcagtactcacaataagacgttggggtttcctatagacgaataagactaacaggtagtccttccgttgtgagtgtgtcaaaaatgtatttcgccatctgctccgctgtggtacgagcaggaataccaaaggttttggaatcgagagattgaagtaatgtggcaactttacactctttctcgcttgtcgaatcgtagataaaggcgtgatccattttgtcaagaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgagtatgggttcggatatagtcaaatgccccaagttgatcagctaacgcccaagtttcttttttcgtgagatacatcaacggtgtacggatattgaagttgtaatccgtcgctaaattaagcgttacgttcattgatttaatgaatacatctcgacaatcaggataaccactaaaatctgtttcacatacacctgtataaatggtttggatcccctgacttttggcataaatggctgtgtaaagtagaaaaagtgcattacgcccatccacaaaggtgttaggcgtgttgcctgtctgcttaatttcagcttgatcgtccattaaggcattagccgtaatggcttttatcacagatgtatcaattaaggtctgtttaacgccaagatcttgagcaatccaacgggctttatctaattcgatggcgtggcgttgtccatattgaaaggtgacggcttcgacattttctttgccaaattctttgatagcaaggaataaacaagttgtagaatcttgtccgcctgaaaaaatcacggcagctttaggtgtaggtttcattgtgttccttagttttttttgcgtgggaggtttgcgaaccacggttgaataaataagcggtacgatgttgcaatatttttgcattatcgcaccgctgtgaaaggcgacattataatgattttatctttttttgcgatttttctttttattatttacttatattaaatagttagtcaataaaacctatatttatcaaatttcagatgagattataatgtgccccatcaagagcgatgtgataaatcactcgcaacatttaactataaacaaaggataacaaaatgaaaaaagttgcaaatgttcatactgcacctgcaaaacactgggtaggcaatgggttccacgttcaatcaatgtttagctataacgataccgataaaaatttagatccgttcttattgatggattacaacccacctcgccattttgatggtggacgcaaatcggattttcgtggtgttggcgagcatccgcatcgtggttttgaaaccgttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgtatcaaggcgaagttgctcacgcggattcttatggtggtggcggtactattgggacaggtgatgtgcaatggatgacggcaggttcaggtgtaatgcacgaagagtttcactcagaacgtttctcaagagaaggtggaatgtttgagatggtacaactttgggtgaatttgcctaaagctcacaaaatgacaacaccaaaatatcaggcgattaaatcggcagatattcctgtcgtgcaacttggtgataatgctggaannnnnnnnnnnnnnnnnnnnnnnnnnnnnnnnnnnnnnnnnnttgctagtacttttagtccgattaatatgtgggatgtggtactaaatgcaggtaaagttcatacttttgctgtaccagaaagccataatctgattattttggtgttagatggcacagtacaaattaatggcgaggacattgctcgtcgtggtgaattagtgacctttgaatgtggcggtgctgatgttctgatcgaggcgaataacgatgctaaactgttagttcttacgggagagccattaaatgaacctgttgtaggttatggtccttttgtgatgaatagccgagaagaaattattcaagctatgcgtgatgtacaaagtgggaagtttgggcggattgagaggtaaaagatagattaaactcttataatcaaggcttaagagctgctcttctttactttcgttttcatccttagctcttggtgatcgcttaagagatcaccaaaattaattgattcattacttgttattagctttgaagatacattcccaatttttgattattacatcatgttaaaaaaatgaataatatctgtgatatgtgtttattttttcacaatgtatcttagagtgaactgaacgatagacttttagtagggggtttagtaggattggcaataatactttattgacaatattcaaagttatattggatgaagtgtaaaagtatttatatagctatatatcaaggagtctttatgagttcaatgcaaatcacattatcattaactgccgcccctgaagtttggggaaaaaatgcaattttatcggcaaacgatcaaggtatgacaattcatctggtaaaagatgaattaaccaccattcaacaagcagctcgcaaaatcaaaaatcagaacattttaaatgttgccttaacaggcgaaggctggggattagagcagtgttgggcgttccatcaaggatttgttagcgtgaaaaatgcaggctcagtcacctatcctgcattaaatgaacaacaaaccgaatttgatgctcgccttgcgtgtagcagctttactcgtgacattattaacgaaccatctgaccgcttaacccccgaagtgttggctcacaaagcagctgaatttattttacaccaagccgataaatatgtaggcaaaggtaaggtttcttttgaaatcgttgctcgtgaagcattaaatgaacgtggctatcacggcatttggacagtcggtaaaggctctgctcatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtaaaggctctgctcatttacctgcgatgttacaacttgactataacccaacgggcaacccagatgcaccagtattagcctgtttggtcggtaaaggcattacctttgacacgggcggttatagcttaaaaccaagtgacagtatgtccacaatgcgtaccgatatgggtggagccgccttagtcacaggggcattaggttttgctattgcgcgtggcttaaaacaacgtgtgaaactctatctttgctgtgcagaaaatatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaaatatggtgagtagccgagcattcaaattaggggatattattacttatcgcaatggcgtaactgcagaagtgttaaataccgatgcagaagggcgtttagtgttagccgacggtttaattgaagcaagcaaacagaaaccgcagtttattgtcgattgtgcgaccttaacaggcgcagccaaagtggcagtgggcaatgactaccattcagtgctatcaatggacgatcaattagttgcccgtttatttgaggcagccaaagccgaaaacgaacctttctggcgtttaccgtttgaagagttccaccgtgctcaaatttcatcttcctttgcagatattgccaatatcggttctgttcctgttggtgcaggcgcaagtaccgcaacagccttcttatcctattttgtggaaaattatcagcaaaattggttacacattgactgttctgcaaccttccgcaaaactgcaagtgatttatgggcagcaggtgcaacggggattggggtgaaaaccttggggaatttattactctcctctcacgagtaatgggaaagataagttgggcattaatgcccaactttatcaagtatggagggaactatgcacctaagtaaatttactgattatgcttttcgtgtattgatgtatcttgctcatcatcaagatgagcttcgcaccattccgcagttagcagaatcgcttcaagtgtcgcagaaccatttggtgaaagtggtgcattttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcacgcccttgaacatttctatcaatatttgaatcaatattcaatttcagaatgtattggctctcaaaaggtgattaaaggtattctatgcgggaatactacgtcagatggctattgagcagaatatacattatctaaaatacatagagacacattttgtgcctctatagttatttattcagattgtgctgttgactcggtttcatcatctttcggctgataaaaacgagcaaccagtagtcctagttcaaataacagacacatcggcacagctagtaatgtttgagagaacatatctggtggggtaaataacattccgatcacgaaagctgccacaataatgtaaggacgcttctctttgagatcttctgctgtggttacgccagaccaacaaagtaaaatgatcgcaactggcacttcaaaacagacaccaaaggctaaaaagatagtcaaaatgaaatcaagatagctattaatatctgttgccattacaacaccttcaggggctgtttgggtcaggaagccaaaaatgagcggaaagactacataatacgcaaatgccacaccaatatagaaaagcagagaacttgagattaacagtggataaactagctttttttcgtgtttatataatgcaggtgcgataaatgcccagacttgatacaaaatataaggcacggaaataaatactgcaacaatcgccgttaattttatcggagtgaaaaacggtgtaaccacattcgtggcaatcatcgttgccccttcgggtaaacgttcagtaagtgggctagaaagtaatgtatagatgtcatttgcccaataaacaaggacacaaaagacaactaaaatacaaataaccgctcttaacaagcggttacgaagctcaattaaatggctaataaggggttgagattcttcgactgacattatttatcctgtttcgttttaggctcaacacttgcaagatcgtcatctgggggataatacgccgtcaatttttcttcgtctgcttcagcaagttctgcaatgcgatccgccgaaagcgtttcggtttcaagcggtgggttttcggtttctttttgctgttcagcttgttgagaaagttgctggctctcttgctcaattttattttgaatttcattaacttgctcttgcgtcagactttcaatttgccctctcgctgagtctaagttagcttgcattttctgtgcagattgtttgagttcttctacggttttgctcaattcaggagataaattacttaaattcaactcttctgctttcttaatgctctcttgcaactcttgcagttttagctcttgagaaagctcattttgaacgttagctgccaatcctcgaatagtgcgaacccagcccatcactgtacgaatagtaataggcaggcgtttcgggcctaataccactaagcctacgataaataccaaaactaattcagaaaaacctatatcaaacacggattatgcctgctctttttctttagctttttgttcagtagattctgcggttttttgttctactttctcaaattcagcgtctttagctttgtcgtcattcatcgcttttttaaagcctttgatagattcgcctaagtctgagcctaatccacgtaattttttagtgccaaataataagacaactaataaaacgataatgactagattccaaatgctaataccacccattgtgtgtacctcttgtaagaataaaaaaataaaaacgtcgtaattatacgagttttcttgctaaatgacacttattttgtcggatttcgtaagaataaaaaagaagtaattcttcaaaatgtggcgttcatcacattattttgctttaatattagtaagaaaatcctaagtttgtttgatttgtgagcatttgtttgcaagaagccgtactttttagtaaatctctaaaaaaatccaaccgctatcttgtaaaaggcgttggatagtttgttatcctatattaaaatgtctaattttccatagtgggctattccacttcactttaaccacagagaacttaaaatgaactcaaaccgtagtttactgattatgggtttgttgcttgtttcgttcttgatttttacgcaatggcaacaggattataaccctgagatccaagcacaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagatccaagcacaaaaacaagcgatggctcaagctcaaacacaacaagttgcaaatcaatcgagtgatgtacccgcttcatctaatgcggcatctatcaatgagcaatcaactaaaggaaaaaccattactattgaaacggacgtgttacgtttaaccgttgatactttaggtggtgatgtggttgattctgatctcttaaaatataacgcagaattagactctaatacaccatttgaattgctacaagataatggcaaagtgctgtatgtggcacaaagtgggttagttggtaaaaacgggattgataccacagcaggtcgcgctcagtatcaagctacagcagagaaatttgcgttagcagaaggtcaagacgaaattgccgtgccattaacatttgaaaaagatggtgtagtttataccaaaacatttaccctaaaacgtggtagctataatgtggcggtaaattatcacatcaaaaatggtgctgcagaaactctcgaagttcagccttacggtcagcttaaacatactttagttgaaagtgccggcaattttgcaatgccgacctatacggggggggcttattcatcttctgaagtgaactataaaaaatatagttttgatgaaatggcaaaagctaacttatctgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagctaacttatctgtagatactaaagcaggttgggcagctgttttacagcattatttcgtatcggcgtggatcccaaatcaagatgcggaaaataatctttatactcgcacaggaaatggcgtaggcactatcggttaccgtgggcctgtaacacaagttgcccctaatggtgaagcgactattacaagccatttatggactggaccgaaagatcaagctgcaatggcacaagtggcaaataactttgacttaaccgttgattatggctgggcgtggttcattgcaaaaccattattctggttattaacattcattcaaagtattgtatctaactggggcttagcgattatcggtgtaaccattgtggtgaaaaccattctatacccattaacaaaagctcaatatacctcaatggcgaaaatgcgtatgttacaacctcgcattcaagagatgcgtgaacgtttcggtgatgaccgtcagcgtatgagccaagagatgatgaaactttataaagaagaaaaagtaaacccaatgggaggttgcttaccaattcttcttcaaatgccaattttcatcgcattatactggacatttatggaagcagtggaattacgccatgcaccattctttggctggattcaagatttatcggcacaagatccatactacattttccctctattaatgggtggttcaatgtacttgttacaaaaaatgtcgccgactccaattgctgatccagtacagcaaaaagtgatgaactttatgcctgtgatgtttactgtgttcttcctatggttcccatcaggcttagtactttactggttaacctctaacttaattacgattgcacagcagtggttgatttatcgtaatttagagaagaaggggttacacactcgtgttaaaaagtaattttataacatgggaacaaagaattgttcctatgttgtatttaaacctcatgatatgaatattcaattaattaatgaaagtgattttactgagcgcttttatgatatttgtgaaaaatggaaattgaagcataatcctagctctaatttagcattagtacagactaatgaacgccttgaattaaggaaacttaatcagcctaaattaggtgctgtagctgtaaattttgttgatggaaaaatgtcgtatcgtcgaaagtttggcggtggtcgtaatgaggctattgtgaaagctgttggtgttaaaggttcgtatactcctacaattattgatgcgacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacagcaggtttagggcaagatgcttttgttttggcatcaatagggtgctatgtgaaacttattgaacgtaatccaattgttggcgcattattggaagatggtttacaaagagcttataaagatttagaaattggtcattttatgagagaaagaatggtattacttcctcatagttctattactggtttaaatccagatcttgactcggtggatgttgtttatcttgatcctatgtatccgtctaagactaaaagtgcattagtaaaaaaggagatgcaactatttcaacaattggttggctgtgatttagattcagatgatttacttttccctgctcagcaacttgctagaaagagagtggttgtaaaaagacctaactacgcattatttttagcaaataagaaacctgatttttgtaaggaaactaaaaaacatcggtttgatatatatctatctcattagaataaaataatattttctacgctaacttaataggagatttatgatgaaaagatttatcgtagtagctttgttatcaagttctgctttagctgcgcctgtaggtgaaacttttacaggtgggggaattggtatggatgttacaactacaaaatataaaaatggtgatttgcaaggtaagcaggcaataggcataaactttactttagactatgcaatagattatggtaggaatttaattggaataattgatggtaaagcaaaattaggaagtagcaatatttttcatgatatcaaacaaaaatcccaatatagtattggatatgctcaaggataccgtctcctaccagatatattaccatacgttaaattacattatagtattaataaaatatcggattttggtagtttcaaagggattggatatgcgattggtgtaaaatatgcaatctctaatgatattgaagtaggtttagaatactcaaaaaataatttgaaacgaaatggtacaaaattaaagggaaatgctattggaaccaatctgtcctatcgtttctaaatatttaagttgtacaagtaagttacctgtgaattggtgatatgaaattgataccataaggattagatctatttgagtgggtctaatcctttttgttatctaatagcatatttgtatgatattttgtaaatatgtctatgaaaatataaacaacctctgtttttgaaataaacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactgaaacatctaagtaccccgaggaaaagaaatcaaccgagattttgtaagtagcggcgagcgaaagcgaaagagccagyragtgatagcagcaaagacagaagaattggctgggaagccaagcgacacagggtgatagccccgtattykaagtttwtgttgtggtactaarctwrcrayaagtagggcgggacacgagaaatcctgtttgaagatggggggaccatcctccaaggctaaatactcctgattgaccgatagtgaaccagtactgtgaaggaaaggcgaaaagaaccccagtgaggggagtgaaatagaacctgaaaccgtgtacgtacaagcagtgggagcccgaaagggtgactgcgtaccttttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttccgccacttatttataagcgagtaaattactcgctttaactatatgtaaataattatataggggcgtagttcaattggtagagcaccggtctccaaaaccgggtgttgggagttcgagcctctccgcccctgccatgtttcaaataaaccgattagttttgctaatcggttttttcatttcagtcgaccttccaaggtatttttatgttagaattttgcagatttttacgataattttatcgttattatgaaaccacttgatcctattattgaacaatttcttgatactctatggcaagagcagggattatcagaaaatactgtagcctcttatagactagatttagaaagttttacccaatggctttctgaacccaatgcatttttaaaagtagactatgttgatctacaaacctttttgggcgaaagactggagcaaggctataaagcaacgagttcatctcgtatgttgagctgtttgcgcaagttttttcgtttcctttatttggaaaagtatcgagatgatgatccaacagcaacacttacatctccgcgtaaaccagcccatttacctaaatcattgagtgaagagcaggtactggatttactgagtattccaaatactcaggatcctttagaattgcgtgataaagcaatgttagaactactttatgccacaggtttacgtgtcacagaactcgtttctctaacactggataacttaagcctgcgtcaagggttagttcgtatcattggtaaaggtgataaagagcgtttagtgcctttaggagaagaagcgagttattggatccaacagttttttgagtatgggcgaagttcactgcttaatggtatgcagtcagatgtggtttttcctagccgtttaggcaatcaaatgacccgtcaaactttttggcatcgaattaagcattatgcgttgttggcgggtattgatagtaataaactctctccacacgttttacgccacgcgtttgcaacacatttagttaatcacggtgcagatttacgggttgtgcagatgttacttggacatagtgatctgtctacgacacaaatttatacccaagtggcgaaaactcgtttaaaatcactgcatcaacagtttcacccaagaggataatatgcaacaaggtttttcaaaatttagttgggcattggcatttttttgtttgcccagttcattatggccattagtattgcttgtatcacctgcattaagcgaaaatcctaaccttagcccaagtcaaattgattggttttctaccgcattttggatttatcctttcattttattggctattgctggcttgctgcataaattacatcaaaagcaaccgctagtagcaaagataggattattggtgggctatatcactttttacggtttaatttactatattatctgcactctttaatgaaaaatattcattagcagccactttgtctactataccctttgaatatttattgtatccatacggttagaaatcaaattacagttgtactgaaaggctatgtggctctttatacctttgataattcaactgtaaccactgtaatccaacaacagcaatcacattatcaattttgccttcaacaacccactgatacgcttgctcacggctcacaacgtggacgagaatatcttcgccttcttcctctaaaccgtaaacaccgccgacttgggtgctatcgactaagcctaaaaagagatgtaaacgctcaaccgcaccgcctgggctgtcccaaatgcttaaggcgtgttccacattgctaacggttaaacctgcttcttcgtaactttcacggatagcaacatcttctggcgtttccccttcatctaccattcctgcaatcagttccactaaccaaggggattggttgcttgttggatcgtaagcaccaatgcggacttgttcgactaacactacggcgtctttgacaggatcataggcaattaatgcggctgccgagcctttaatcattaattcacgcacaatttcaccgcttactccaccattaaataacttgtggcggaaatacatttttttcattgtgaagtgaccttgataaaccacttcttcttttaagatctctaaatctttttgctgaaattgctgaatttgtgtcataaaaattccttagcttttatgtaagcgttttgaatgaacaatatataaagcaacgatcatcactaaaatagctaatgcaaataataacgtgtgcattgcattagagtgatctacgataattaaacgtaccattgcggtaatgccgatatataaaaaatagcgtaatggaaaatggtagttatatttaaaatattgaacaatgagagctagaaattcaaaatataaaaagaaaatcacaattttttctacaatttggaatttttcactatggctaaaaaataattcaattaatgagtatgcttcataaaaaagagagtaagctaaaattagccctatcactaagagtgaaagatttaatatccattgaaaactctcagaaataaatttcccgaaacgagaatgttgttcttctaaattaaatttattcatactatccttaatttacttgataaataattgggtgaagatgatcaaatgagatgtagtccccatttttccattggctcagttttggtaatgataacatagcctgagtatgttcaaaaaaataagccaaataaaatggaagttgatgataaaagcagagttttcctgttgggctataggcggttgtgatctgctgtttacttaatgagtgggttacttccgacagttttataattccagaaccctgtgatttaagcacagcttctcgcaaacaccaacttaagtaaaaacgactttcaagggaagagagttccgagaatagatgatgattatttatttcagctatttcttgctcactggcataataatgtaataaatcgttaaaacgacgtattttttgtgggtgttcaatatcaatacccaccacttttttcggggattgataagagaaaataatcgcaacccaatcgcccgaatggctaatattaaaatcaatctcgctatgttcaatataagggcgcccactttctgttttaacgatatgagttaataaacttttatctaaatgatatttttcaaataattgatgtaacaggaaataagccatacggcgacttttccatttttttatttgataagctgacggcttatcaagagatttgtttatattccccaaataatttaaaaaatctgaagggataaattcatcatttggagcaaaaacaatttcaatagtattcatagctgtcattatagaagaaaaacccgataacgatatttgttatcgggttttattgagtatagaattagcaatttaaaagctaaatcaaaaattatttgatttctactttcgcaccagcttcttctaattctttcttaagtgcttcagcttcacctttagagatgccttcttttaatgctgctggagcagattcaactaagtctttagcttctttcaagcctaagcctgttgcaccacgtactgctttgattactgctaccttgttagcacctgcatctgcaaggataacatcgaattcagttttctcttcagctgcttctgctgggcctgctgctactgctactgctgctgccgctgctgatacaccaaatttttcttccatcgctgtaattaattcaacgatttctgatactgatttagaagcaatcgcttcaatgatttgttcgttagttaatgacataacaatcaattcctaaagtaaataagttaaacgagttgagaatacggcgaataaaaattatgccgcttcttgtaatttgtcgcgtaatgccacaagagtgcgaacaagtttgcctgccgcagcttctttcattgtgcccattaaacgtgcaattgcttcttcgtaagttggtaatgttgccaagaattcaacatcttggattttaccttcaaaggctgcacctttaacttcaaactctttgtttgcttttgcaaaatctttgaacaaacgtgctgctgcacctgggtgttcgttagagaatgcaataagagttggaccagtaaacgtatcttttaagcactcaaattcagtaccttcaaccgcacgacgtaataaagtattacgaacaacacgcattgaaacgcctgcttcacgagctgctttacgtaactcagtcattttctctactgttacgccacgagaatccgcaacaacagcagaaagggcacctttggcagcttcgtttacttcagcaacaattgcttgtttgtcttgaagatttaatgccattggttttagctcctgatacactccacataaatactgtggaatttacaaaaaatctcaaaaaagtaaccgcttgagcgacgtttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggctaaggtgtacagaagcagataattctgtctgttcaccatctacgtaggttgttttcattaagaaactgttcacacaggttcacctacggtcttggacggggcttgagataaggctcagcaccatcatttactatccattatggagtagcaattttgcaattttacccttaaatttttaggctgtaaactaaaaattcatgcgaatatctggtatctgcttgttttacgtatctcattattcatccactaaactacattgacactaccctctttaaaatcttgatcatatgtaaacacactttcctcatcgattaccttagagactttaaaactatttctggcacaaactgccccacatctccctgatggcgataaatttctcttaccattgtcgaagaaagataacgccactctacggctgggggtaaaaaaatcgtttctaactgccctgctaatttttgatttaactgtgccagttgaatttcatactcaatgtcgtccgcccctcgaatacctcgaataagcgtggtggcattatgctgtttagcaaaatcgaccaacaacccactaaagccgatcacctcaacattattcagcatttgacagctttgctgtaccaactcaacacgctgttcaagactaaatagcggttgctttgagggattttttgccacagccacaatcactttgccaaacaatcggctactgcgttgaataatatctaaatgcccatttgttatcggatcaaatgtgccagcataaattacagtttggttcattctatttctctaaataaggggctaacagttgaagatgacgagttaaagcaccttgattttcttgtaatacactcacccctgcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacactcacccctgcttgactaattttttgtccaagttcaggcttttcaaaaaagtaattgacggcatcaacaatcgaagtgacatcactttgaatttcaatcacgccccgaacctctcttaatttagcaaaaatctcagggaaattaaaagtatgtacaccagaaatcacgggaagttcaaatgcaattggctctaacggattatgcccaccgtgtttgactaaacttccgcccacaaaagcgacctgagccaagccataaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacctgagccaagccataaaacagcatcatctctcccattgtattgcctaacagtaccgacgttcctgcacttaaaagttcaaaagaagagcgtgttacatagggcattcccatattttttagtaaattttccacactatcaaaccgctcagggtggcgaggaacaaggatcagaactaaatcaggatattgctttaataactgctgatgtgcttccaacaacatcttttcctcaccttcgtgagtgctacctgcaacccaaatcggacggtcaagtaaatgtagctcaacggctgtttgagttaccttctggcgtaattgaggtgaaatttctaaatcaaatttaagattgcctgtattgactaaatgttcagcattaaatcctagtcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactcacctgatcttgagccaagataaaatcaatttcactcaacatctcttgcaaacaaggcttaatccaaccataacgttttgctgaacgaggcgaaagacgagcattggcaatcacaaagggaatttggcgttgatgggtttgatgaattaaattcggccaaagttccgtttcaatcacaatcaataattttggttcaacaaagtctaaaaaacgtttcaccgcatcgggcaaatcatagggtaaataaagatggtgaacacgattgccaaatgctgctttaacacgatctgaccccgttggggttactgtcgtcaccgtaacagacaactgaggataattcgctaaaatcgctttaatcaaaggagtagctgcaatcacttctcccacagaagcggcgtgaataacaatgccatttgcttgaggcttgatttcacccgatgaataaaaaccgtatcgttccttcaaacatttacgacgcttaggtagagaatgttctttctgccatatgataagagaaataataggtagtactaaataacctagaatagtataaattatacgtagcattatttactcctactcaaactccaactcaacggcattttcgcctaaaaaatcttttaatttctgtagcatcgtttcttttggggtaacacgccactcaacgccactacgcaataatacacgcccttctgggctttgataatagaaatgtaacggtaatgttccctctttataaggctcaataatagcggtcagatctttgataaattttgctgagagctgttcttgtttgatcgctagagctaaacttcttgcataacggctacgagcttcatcaagagtaatcatttcgcgaaccgccatttttaagccaccactgaaatcatcgtgttgcacagcccctgttgcgataataatctgatctttttgcaacagatcgccatagttttccagtgcttctgaaaaaagggtgagatccattttacctgaacgatcttcaatcgttgcaatcccaatacgactaccctttttggttgtcgcaattcttgcccccataattaatccagcaacggtagtagtttgtcctcgataggttggttgaacttcatttaatttattcggtgcataatgagctaactctttcaaaaaacgtccaacagggtgtccacttagatataaacctaaggtggctttttcgttatctaaaatggtctgctccgtccattttggcgtgttggcataggcgttctgaacttcttcgggggtttcagtcagcacgccaaacatatcactctgtccaagtgcttccattttattatgttgatcggacgctctaagggcatcttctaaatttttcatcaacgccgcacggtgaggccctagtttatcgaaagccccagccataattaatccttcaaatgtgcgacgattaacttttcttaaatcaacacgagcggtcagatcgaacagatctttgaaaatcccgtctttattgcgagcttctaacatcgcatcaatcgggccttcgcctacgcctttgattgcccctaaaccatagacaatttcgcctttttcattgacactaaaacggtgtttaccactattaatatcaggcggaacaacggttaagcccatattgatacattcatcataaaagccgacgattttatctgtgttatccatctctgaagtcatcaccgccgccataaactccgctgggtaatgggttttgagccacaaggtttgataggataccaacgcataagccgccgagtgcgatttattaaagccgtagcctgcgaatttttctaccaagtcgaagattttcatcgccaactcgccatcaattccctgcttcttcgccccttcttcaaaggttgcccgttgagccgccatctcttcgggctttttcttacccatcgcacgacgcaataaatccgcaccaccgagcgtatagccagccaacacctgtgcaatctgcattacttgctcttgataaacgataatgccataggttggctctaaaatcggctgcagcgactcgtgctgatactgggcatcaggataggcaatcggctctttgccgtgtttacggtcaataaagttctgcaccattcccgactcaagcggacctggacggaacaaagccaccaacgcaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaatcagatctttcataccccgtgactctagctggaataccgccgtggttttggctgcttttaataatttaaaggctttttcatcgtcaaggggaatactttcaatccgaaccagtggcttaccttctttttccaagcgttgattgatcatctctaacgcccatttgatgatcgtcagcgtgcgtaagcccaaaaagtcaaatttaaccaagcctgcatactccacatcatttttatcgaagtgggtcacagggtgtaaaccgtaagagtcgaagtaaagtggcgaaaaatcagtaatcgccgttggggcaatcaccacgccccctgcgtgtttacctgcattacgtgttaccccttcgagcttacgagccatatcaatcaaggctttcacttcttcatcagtatcataaagctcaggcaatttgggctcggcttcaaaggcttttgccaacgtcataccagggtcaggggggatcaatttagaaatacgatccacaaaactataagggtgtccaagcacacgccccacatctcgaataaccgcttttgccgccatagtaccaaaggtaataatctgcgacaccgcttggcaaccataggtttccgacacgtgttcaatcacacgatctcgcccgtccatacagaaatccacatcaaaatcgggcatcgaaacccgttctggatttaagaaacgttcaaagagtaagtcaaattcaaggggatctagatcggtaattttcaacgcataagcaaccaaagatcctgctccagaaccacgccctggtccaacaggaatatcgttatctttcgaccactgaataaattccatcacaattaaaaagtagccgggaaagcccatttggttgatcacgtccaactcgacttgcaatctttcatcataaacagaccgcttgcttgcccgcacttcaggatcaggaaacaaaaataccagacgcttttccaaaccttctttggcttttttgactaaaaaatcttcagtggaaagatcgcccgtcgggaaattcggtaagaaatattcccctaaacgaatggtgacattacaacgttgagcaatgaataaggtattttcaatcgcttgtggcaaatcggcaaacaactgacacatttcgtcttctgaacggaagtattgctgttccgaatatttttgtgggcgtttaggatcgtccaacgtaaagctgtcgtgaatggcaacacggatttcgtgggcttcaaaatcgtcctgttttaaaaacatcacatcattgacagccaccaacggaattgcaaatttttgcgaaaaagtgaccgcttgttgaatataacgttcttcatcacttcttcctgttcgacaaagggaaagataataatgattgtggaaataacgttgataaaaagccaaaagctgttcggcttcttgctgattttctttcaataatgccttacctacatcgccattgctaccgcccgaaagcaaaatcacgccttcattatgttctgccagccacgctttttccaccacaggaaattccacatagccctgttgataagcctttgaaagtaaaagggtaatgttatgataaccggtattatttttggctaaaagggtaagttcgtataactcttcactctcaggttcagggcgaaccatcacatctgccccaacaatcggcttcacccgatcctaaggcttcgccgtaaaaacgcaccaagccacagaagttagtaaaatcggtcaatgccattgcgaccatattgttggcaacacaggctttgattaacggcttcactttcgccaagccattaatcattgagaaatcactgtgtactttcagatgaacaaaacgaggttgggacataatggttattttctatttatattaaatgactttccaatgcattgtcgaatgtaagctatctttattcaccacaaacggatgagcatcgactgccttcaataacatctttaatttttgttttaattttgcaggatcgatcggctgagggaataaacgtgaattacttcttttttgctctaaatgtaatactatctttatcttatttttcttcaaaaactgtttagcaaactgctgttcgctttgattattcgcatttaatttcatcgcaacaattccagccaaggtatctctaactttaattgctatttcatcggctaatggcattgttttcgttctctgatattgtcgataatcttttacttcaatcatccagttatcattttcatcaaccacaataatatctactgctttggttccatttgcaaaagcattaaattgattacgataaaaagataaatcatcatatttttcaacaagaataaactcgttaaaaataaacgttaaatcaccttctttaattacaatctctgacatttattctaccaatgctaaaaatctatcggattgttcaagctcttcgtctaataatgttaaaacttccaattgattaatactatcaccttgatcaactacaataccattatctatcgtttttaaaccgaaataaaattgttttaaatgagcaaattcttgtcgtttagaaagtatttctagttctcttaacaaaaaaagtgaatgagttgcaataaaaatttggataccgttattacataattgcaaaataaccttagcgactgttttaataagtttaggatttaaatttgcctctggttcatcccaaaataacgcacctttacctaacaaagatcctgttgcaattaatctcgcaatcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattaatctcgcaatcatcgctaattttcttaatccctcagcaaccaaaggaatttccatagttccttgtccctgaatagaaagataaaaacgcccattatctaaaaccgttttcccccccattgcctcttctaatggttttaatagctcttttgcacgctcctctctaggacctttggctaaataatttcctaataataaacaagtgtcataatatgtttcctcatactctaaataatgattattataagtatgaacaaaattaggataaatcgttaataattctcttgtaggtaaaaaaacaggattattctctattttacttttaggtaatatatctatttgaacttcggatttacttgatgtcgcaaaactaaattgacaattataaaagtcattttcaaatttagctgaaatttcacaacgctctctcccttgtttacggcgaacaagtcggcctaaactttcaggtctaaatacattaattaatttatctgcataattcttttgcatttgcgttttacttacagaaaaagcagaagcattacaagcaatgagagaatacgctaattttaaaatgtgcgattttcccattccattttcccctataataacatttaaatggggagaaaaatttaaatcaacttcgttaaatactgtgaaattctttaatactaatttatttaacatagtctttccttaatttaatcccttttcttattcaacaaccaccacaccacacttaaacagagcaaacttgggattaatgcccctattggtacgggtagccacgaaacaataagacttaaattaccaaagacgatattcgccacataaaatacaaagcctgcgagaataccgatcacaatttttgcccccatcgtactactgcgtagcggaccaaaaataaaggaaatcgcaagcaacatcatcaccgccattgagatcggctgaaaaactttacgccagaacgtaatctcaaaacgttttggatcttgccctgtatcttttaaaaagcctacataatccgctaatcccgaaatagacaacgactctggcttcaaggacacgatccctaacttgctcggcgtaatgcttgttttccacgcctgatctgtttctctggtctgggttattccgctttcgtgaatttctgatttatccacctgctgtaaaagccagccttgttccgaataggtcgctttttccgcctgtttgatggattttaaaacctgattttcaaattggtaaattaaaatattatttaagttacgttcatcttgaatttgacgaatatagataaaatcattgccatctttcgcccaaaatccgccttgggtcgccagcattgaaccgccactttgagcaatagatcgcatatttcgggcatattgttccgtttgcggtacgccccattcccccataatcatcgtaatcaccattaatggaattgccgttttcatcaccgccagcccaatgcggaagcgagaaaatccagccgattgcattaccactaactcactacggctcgccaaaccgcccagccccattaatgaaccaagcaacgctgcgattgggaaaaaggtttcaatatcacgaggcatcgtcaatagggtgtaatatgctgcgtgtaagccatcgtagctccctcgaccaacggaacggaactcttcgacaaatttaataattgccccaagccctactaacataaatagggtaagcataatggaagcaagaatggttctgccgatataacgctctaatacattcatttacttgccacctttttacttgaaaaacgataacgcaatgccgaaaaccatttactttcccagctatttaaaagagtgccaagcactaaaaatgccacagacaccattggcattaacaaagacacatttagcttacccgaagcccctgccgattttaacgaactctgtaataagaaatagattaaatacaacaataacgcaggtaataattttgcaaaacgcccttgccgtgggtttacactactcatcggcacagccagcaacgccatcaatggcacagataaaatcaacgctaaacgccactgcaactctgcctgagcttctggggaagtttcagcaagcaacttctgaaaatcggcacgttgaaccaatttttcatcactatcaacatcttgatagccgagataggcattgtaattatcaaaatgcgaaatacggaaatccgccgtttgaggcgttccttcataacgagtactattggttaaatttaacatttgatcgccattcggaagcccttgtaattcccccgatttagccaccaccacagagggtttatttttcttttgctgttcaggctgaaaaacataaatatcattaatggtgttatctttaatgttatcaataaataacacatacccacctgcagacataaattgccctgcggctaatgcagcaaagcgaggatttgcttttgcttcagccaacatttcgctctgtttattaatcgcccaaggggtaagccaaaagacattataaaccgccactgccgtggtaaagatcgataaaaataacgctgctttcactaaaaggctctgccccaccccacaagcgcgcattaccgtaatttcactttcagcataaaaacgccctaaagtgagcaaaagagcaataaataacgacaaaggcaacatcaactgtgccattgtcggcatacctaatccgagcaagctcaatactaagtctgtagggactttgccactcacagccgagcttaatactcgtactaattgttggcagaagaagatcactaacagtatgaaaagtatagcaatttggcttttaaatatttctttcgttaaatatcgacttaaaatcacgacaaagttctcattttgacaatttatcgcttgcaattttcaagcaaacaggtagttttatgacccatattttaattgcaagttcaagcggttggatttgggtaaaattttgaatagcccacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtccgtaaagctgcgtgtccataaaactatatatgtccgcaaatatgtgtttgagccagaaatatggacacacgcagtgtgtccctacctttctttatcattcaaacaaaggctaaataatattgtaaaattttaccaaaacccaccgcttgcaaaatgtgtgatcatacccttttatacaaaaaaaatcacgggagtattttatggaatttagcgttaaaaacggatctgttgaaaaacaacgtacaggctgtctggttgttggggtgtatgaaccccgtcgcttatcgcctgctgcggagcaattagataaattaagtgacggctatttaagcaatttattgcgtaaaggcgatttagaaggacgtgttgggcaaacgttattactacacaacgtacccaatgtcgccgcagatcgcgtgttgttagttggctgcggcaaagagcgtgaactgactgaacgccaatacaaacaaaccattcaaaaaatggtacaagtcattaacgacacaggctcaacggaagcaatctgcttcttaaccgaattacacgtcaaagcccgttccgtttactggaatatccgctttgcgattgaagctattcaagaaaacggctaccaatataacgaatttaagagcgtgaaacctgaaatccgccgtgaattacgcaaaatcgtatttaatatcgctaaccgcaaagatttaactgtggcagaacaagcggttgaacacggcaaagcgattgcatcaggcgtgatcttcgccaaaaatgtagcgaactgtccgccaaatgtttgcaacccgaaatatttatccgaattagcaaaaggcttagccaaagagtacgataacatcactaccacggtactggacgaaaaagagatggcggcattacaaatgaacgcctatcttgccgtttctcgtggttctgaaaatgatgcttatctttcaattatcgaatataaaggatcgccaaatcctgcagcaaaaccgattgttcttgtcggcaaaggcttaacttttgacacaggtggcatttccattaagccgtccgatgcaatggacgaaatgaaatatgatatgggcggtgcggcttctgtctatggcacaatgaaagccattgcggaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaagccattgcggaaatgaaattgccattaaatgttatcggcgtactcgcaggctgtgaaaatatgccagacggcaacgcttatcgccctggtgatattctaaccacaatgtcaggcttaaccgttgaagtcctcaataccgatgcagaaggacgtttggtattatgtgacaccttaacctatgtcgaacgtttcgatcctgaattagtgattgatgtggcaacactcacaggggcgtgtatgatcgcactaggcaaccacaatagcggattgatttcaccaaataacgcacttgcaaacgacttattaaatgctgcagaacaagcagatgataaagcatggcgtttaccaatgggcgaagagtatcaagaacagcttaaatccaactttgccgatcttgccaatatcggcggacgtttaggcggagcgatcaccgcaggggtattcctatctaacttcaccaagaaatacacttgggcgcatttagatattgcaggcactgcgtggaaatcaggggctgcaaaaggggcaacaggcagaccagtgccgttgttgagccagtttttgcttaataaagcgggcatctaacctgtttgcctcctaaatacaagcggtcagttaggctctaaaatttgcaaattttgagtcgaaaccgaccgcttgtaatggcagaattttcactaaacaaacatataattcttaacccaaaggcgttattccgttagaataacgcctttttacgttttccttcgcgaaggtcctgacttgttatcagaaagagaatccacatgttacaacataaacccgaacttttatcgccggcaggcacgctgaaaaatatgcgttatgcctttgcttacggggcagatgccgtttatgcggggcaaccacgttacagcttgcgtgttcgcaataacgaatttaaccacgctaatttgaaaatcggtattgatgaagctcacgcactcggcaaaaaattctatgtggtggtcaatatcgctccgcataattctaaactcaaaaccttcattaaagatctgcaagtcgttgtggatatgaagcccgatgcgttgattatgtctgacccaggcttgattatgttggtgcgtgaacatttcccagaaatggatattcatctttccgtgcaagcgaatgcggtaaactgggcaacggtaaaattctggaaacagatgggattaacccgtgtcattctttcccgtgaactttccattgaagaaatcgcagaaattcgtgagcaagtgcctgatatggaaattgagattttcgtccacggggcattgtgtatggcttattctgggcgttgcttattgtctggctatattaacaaacgtgatccgaaccaaggcacctgtaccaacgcttgtcgctgggaatatcaggtggaagagggtaaggtagatgatgttggcaatattgtgtcaaaaattgatccagaacagcagattgaaattaaaaatgtcgcaccaaccttaggcgaaggcgataccactagcaaagttttcctgcttgccgaatcgcaaaaaccggatgagcaaatgaccgcttttgaagatgaacacggcacttacattatgaactcgaaagatttgcgtgcggtgcaacacgttgagaaactgacccaaatcggcgtacattccttaaaaattgaaggtcgaactaagtcattctactattgtgcaagaactgctcaagtttaccgtaaagcgattgatgatgcggcagcaggcaagccttttgatgaaagtttaatggatacgttagaatccttggcacaccgtggttatacggaaggtttcttacgtcgccatacccacgatgaataccaaaattacgattacggctattcgatttcagaacgtcagcagtttgtcggcgaatttaccggcaaacgcaatacagaaggtatggcggaagtcgcagtgaaaaataaattcttacttggcgatgaagtcgaaatgatgaccccaaaaggcaatatcgtgttcaaaatcgaacgaatgttaaaccgcaaaaatgaagctgttgatgctggcttaggcgatgggcattttgtctttttagatgtaccagccgatgtggaattagattatgctttgttaatgcgtaatttggttgatgcgaatactcgaaatccgcataatttataaaagataaccttaatcttattactacttagcggaagtatgtacagaataactaaagcaattgaactgataagcggaagatggactanagccaaatcttaccgcttatttttaggagataaaatgaaaaaaacgctctcttttagccttattgcccttgctttaggcttaacggcttgtaccacgaaaacctaccaaagcaccttaaccgaaggggtggataacagcgttgccccacaacaagatttttatcgctatgtgaatggtaagtggctggataccgcccaaatcccgtctgatcgtacttcttggggaaccttagcagaactcaatgaattgaacgaaaaacgttctgttgagctgttacaagcggtcatttcagacccaaattttgcaaatgatgaaaaagcacaacgtttaaaagcactgtatcaaagttataccgatttgcctgctcgtgaaaagcttggtttaagcccaattcaagctgatttaagccgaattgagaggataaaaacctttgccgagttagagcaatatttaattaatgaaaccaagcaaggcaatgagatgttatttggttggtcggtgtttgcccacctgaaaaactctcgccaaaacgcaatctatttcagtaatgatagccttggtttgagcaatgattattatcaaaaggatacccctgaaaatcgtaaaacattacagctttatcaagattatgttgcacagatgcttcattttgctcaggtaaaaaatccgaagcaaaaagcaaaagcgattgtggagtatgaaaaagcgattgcgaaaaccctatttaccaatgagcagcgtcgagatattcaaaaacgctataatcctttatctatcaatgaattagctaaagcgagtaaacatattaatcttgcaaattatctcaacgccgttggggtgaatacggaagaagttattgtgtgggagccgaatttcttaaaacagtttgatcagctaatcaacccacaaaatcttgcgttaattaaagattacctacgctttaaaaccgtttcaaatgcgtctacctatttaaacaaagccttagatgatacgaattttgctttttatggcaagcagttggtgggacagaaacagcaaagaccgttagataaacgtgcgttacgtttgattaacaaccaaattgggcaggaatttgctcaattttatgtggaaaaattcttccctgcgacagctaaaaaagacctgcttgaaatggctggttatttggttaaagcctaccatcagcgtatcgacaatttaagttggatgtcggcagaaaccaaagcaaaagcgaaagtgaagctagataaattcatcgttgaagtgggttatccaaacaaatggaaagattatagccaactgcatttaaaaaccgtagaacagggcggttcgctttatgctaacttgcgtgaaattgccaaatggaattaccaagaagccttaagtaaaatcggcaaacctgttgatttgaatgaatggggaatgttgccacaggtggtgaatgcttcttatagcccattgatgaaccgtattgtattcccggctgggatcttacaagcaccgctttacgatatgaacgccgatcctgctgttaattttggggctatcggagctattatcggacacgaaatcactcacggctttgacgacagcggttcaaaatttgatggtgatggcaacttaaaagagtggtggacagcagaagatcgacaaaaatttgaagcccttgcagatcaactagttgctcaatttgataaatttgaagtcgccccgaaaatttttgtcaatggacgtttcaccttaggggaaaacattgcggatctgggcggattaagtattgcttatgatgcattaaaacgttatgagcaagatcacggtgtgaccccaatcttggagaaccttaccccagatcaacgcttttttatgagctggacacgttcgtggcgaaataaagcgacggtccaagccttaacgcaccaagtgaaaagcgatccgcacgccccaggacaataccgtgcttttgcccctgtattaaatatttcgggcttccataatgcttttaatacaaagcaaggtgatgcaatgtaccgtccgattaatgagcggattaggatttggtaatatacaaatttcccatagaagagaggctgagtatataatcaaggaaaaattcataaattcccagtataatctatccacttatttaaactaaaaggaatacaaaatgcaaaacccaaaagatgatgtactttatgcctctgttgaatggtccgattgcagcgaaggttatacggatattctgtatcataaatcgactgacggtatcgctaaaatcacaattaaccgtcctgaagtgcgtaatgcgttccgtccgcaaacggtaaaagagatgatccaagctttctctgatgcgcgttttgatgaaaaaatcggtgtgattgttttaacgggtcaaggcgaaaaagcgttctgttctggtggcgaccaaaaagtgcgtggcgattacggcggttataaagacgaaagtggtgtacatcacttaaacgtattggatttccaacgtgatattcgtagctgcccgaagcctgtggtggcaatggtcgctggttatgccattggtggcggtcacgttttacatatgctctgtgatttaaccattgccgcagaaaatgcgattttcggtcaaaccggcccgaaagtgggttcattcgatggcggttggggtgcaagctatatggcgcgtattgttgggcagaaaaaagcacgtgagatttggttcttatgccgtcaatatgatgcgaaagaggctttagaaatgggcttggtgaataccgttgtgccttatgctgatttggaaaaagaaacggtgcgctggtgtcgtgaaatgttacgcaacagcccgattgcattacgttgcttaaaagcggcgttaaatgcagactgtgacggacaagctggcttgcaagaattagcaggtaatgcaacgatgttgttctatatgacgaaagaaggtcaagaaggtcgcaatgcgtttaatgaaaaacgtgcgcctgactttagcaagtttaagcgtaatccttagtatgtataaaatggtatagtagacaaagtggttgctaatgaatatttttaatggggctgacgtagattagctagtatgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctgaccgcttataaaacacaagctcaagtatttacttgagcttgtatataaaaagcgtttactactcttttttcatttcagacgcaaacagataagcacctacaaagattctggttaaagtatctaataagtaagcctcactaataccctcctcaacatccagatcatctttcaaagcaagatcaccatctttatcaatataagcagttaaaaatctttttgttgcattccatttattgacacttttcaatgaagtattatcgccatcaaaatacatcctaaaagttaaagagccatcgtcacgttgattataaattaccagctttatcccagagtcgctggtaattctaatccttcctttttcaatcagctcaacttttggatattttttcttcacaatatcaatcaattgttgatcagaaaacttagtataaacttccaccattttggtttctgcataagctgttgtagaaacgagcgtagtggtaatcaacatggcaaaaaacattgatagaaaataagctggcgttttgaggtatttataaattttcataaacacccccaccattttctaactgacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacgatagagattgagagaaagtttatcccttgtttgagcggcaatatctgtttcgtaaagttgcttatcaacaggattgcttaaatcatattggtagtaggttccacttaatcctttataagcaaacataccgtttttcatctgttctttaatcataaatataccttcatagtaatgctaaatgttttggcagagatgattttagttcattacgcaagtaatgaattaaataatgctagcattattgaaaattttgattaaaaaatggtaataagcggtaagatataagaagaattttgaaaaaacaaaagcccgataaatctatcgggctttttaagtcaatgtagaattattctgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttgttcagctgcaacttcaggacgatcaactaactcaatgtaagccattggtgcgttgtcacctgcacggaaaccacattttaagatacgagtataaccacccgcacggtttgcaaaacgtggacctaattcattgaataatttagcaacggtttcgatgttgcgagtacgagcaaaagctaaacgacgattagcaacgctatctacttttgctaaagtaattaatggttcaactacacgacgtaattcttttgcttttggcaatgttgtcttgatgatttcgtgactaactaatgcacttgctaaattacggaacaacgcctgacgatggctgctgttacggtttagttgacgtccactcttacgatggcgcataaccttattccttctaagaaaatctaaacctaaaattagtcttcagcaatacttgctggaggccaattctcaaggcgcataccgagtgataagccacgagaagcgagaacatctttaatttcagtaagtgatttcttaccaagattaggtgtttttaataactcaacttctgtacgttgtactaaatcaccgatatagtgaattgtctctgctttcaaacagttagcagaacgaactgtcagctctaagtcatctactggacgaagaagaattggatcaaattccggtttctcttctttcacttctggctgacgaacatcacgcaaatcaacgaatgcagcgagttgctctgctaaaatcgttgcagcacggcggatggcttcttctggatctaatgttccgttagtttccatctcgataacgagcttatctaagtctgtgcgttgttcaacacgagcagcttcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattgtaagcaatgcgatctaccgggctaaaacgtgcatcgactaataagcgaccgattggacgatcgtcgtcttgtgtatgtacacgagcagatgctggtacataaccacgaccacgttgtacacggatacgcatactaattgatgcgtttttatccgttaagttacaaataacgtgatctggattcacaatttcaacatcaccatcgtgagtaatgtctgctgcagttacagggccaatcccagatttagtgagtgtcaaaataatatcatctttattttgcacttttaccgctagacctttaaggtttaacaatacctcaagaatatcttcttgtacgccttctttgctgctgtattcgtgtaatacaccatcaatttctacttctgtaactgcacaaccaggcatagatgaaagtaaaatgcgacgaagtgcgttacctaaagtgtggccgaaaccacgttctaacggctctaaggtcacttttgcgtgagttgaactaatttgttcaatattcactaagtgtggctttaaaaattctgttacagaaccctgcattttatcctctctttgcttttaagcttaactattatttagagtaaagctcaacgatcagatgttcattaatatctgctgatagatcagaacgctcaggagtacgtttaaatacgccttccattttagttgcatcaacttctaaccaagttggtttttcacgttgagtagctaactctaatgatgctttgatacgtgcttgttttttagatttttcacgaacagcaatcacatcatcaacagaaacttggtatgaaggaatgtttacaacacgaccatttaccacgatagatttgtggcttactaactgacgtgcttcagcacgagtagctgcaaaacccatacggtaaacaacgttgtctaaacgaccttctaacaatactaataagttctcaccggtattgccttttaagcggttagcttctttatagtagttacggaactgacgttctaaaataccatagatacggcgaactttttgtttctcgcgtaactgactaccatagtcagataaacgaggcttacgagcaccgtgttgacctggtgctgtatcaattttacattttgactcgatcgcgcgaacacctgatttaaggaataaatcggtaccttcacgacggcttagcttgagttttggacccaaatatcttgccattttctttctccaattatcctaacgtcaattacacacgacgttttttcggtggacgacaaccgttatgtggaatcggagtcacatctgtaatgttcgtgatacggaaacccgctgcgtttaatgcacggattgttgattcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacggattgttgattcacgacctggacccggacctttaaccataacttctaaattctttaaaccaaactctttaaccatttctgcacaacgctctgcagcaacttgagcagcgaatggagttgatttacgagaaccacggaaacctgaaccacccgcagttgcccaagctagagcattaccttgacggtcagtaatggttacgattgtattattgaaagatgcgtggatatgagctacgccatctacgatctgtttttttacacgtttacgtgcacgaactggtgttttagccattatttatctactccgattattttttgatcggtttgcgtggacccttacgagtacgcgcattagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgttgaccacgtactggtaaactacgacgatgacgtaaaccacggtagcaacctaggtctaaaagacgtttgatgcttaaagttacttcacgacgtaaatcaccttcgacagtaaatttaccaacttcttcacgcagtttttcaatctgctcttcagacaattctctgatcttcacatcttcagcaatacccgttgcagcgcagatcgcttttgcacgagttttaccgatgccataaatagcagtcagtgcgattacggtgtgtttttgatcaggaatgttaatgcctgcaatacgggccactatgcactcctatttaactaaagttattgatatgctgatcttgaaaagcccgtttcaggatactcaaacagcatatcaggacgaaatgagctgagcagtataaccgctcagcaggttctttgcaagaaataatgtcaattaaccttgacgttgtttatgtttagggtcgctacaaattacgcgtacaacaccttcacgtttaacaactttgcagttacgacacattcttttaactgaagcacgaactttcattgcttatccttttgatctaagggcttattgccctaagcctttcaaattggctttcttcaacacagaatcatactgtaaagacattagatgactttgaacctgtgcgatgaaatccataataacaaccacaacgatcaataatgaagtaccgcctaattggaaagatactttccataatgatgttatgatataaggaaccaaacaaacaaaggtaatatataacgcaccaattaaggttaaacgtgtcattactttatcgatataacgagatgtttgctcgcctggtcgataacctggtacaaatgcacctgattttttcaaattatccgctgtatcacgaggattatattgcattcctgtataaaagaatgcaaagaagattacagccattgtaaataatacaatatagagtggctgacctggttgtaataactgtgataaatcaaataaccattcaaaaccttcgcttgttccgaaccattgtgcaatggttgctgggaataaaataatacttgaagcgaagattgctgggattacaccagccatatttactttcaacggcaaatgagattgtcttgcaggtgccatcattcttccctgctggcgacttgcatagtttacaacaattcttctttgtccacgttccacgaagacaacaaaatatgttacagcaaatgcaactacagctattagtaataacactaataatgaaatctcgccttggcgagattgttcaatagtttgcccgattactgatggaagatcagcaacaatccctgcaaaaataattaacgaaataccattaccaatgccacgctcagtgatttgctcacctaaccacatcaggaacatagtacctgttactaaactaattacagaagttacatagaacagcatatttggattaggaactaatccagctagcatattcggcagggctaatgaaataccaatagactgaataaatgctaataacaacgtagcataacgtgtatatttgctaattttacgacgccctgcttcgccttcttttttcaactcggcaagtgctgggtgtaccgctgtcaataattgaataatgattgacgctgaaatatagggcataatccctaacgcaaatatagaagctctacttaaagcaccaccagagaacatattgaacatatcaatgatggtgccttgctgttgtcgtactagctcggataatacagaagcatcaataccaggaacaggaataaaagaaccgatacggaaaacgattaaagcacctaaaataaacaataatcgtgattttaattcaccagtccctttttgggtattaccttgatatcctggttgtttagccatttattattcctcgatagaaccaccagcagcttcgatagcagcttttgcacctttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacgcctaagcctttaatcactactgctttttcaactttacctgaaagaattacttttgcagataaaatatcttttgtgattacgtttgctgcttttaacgcatctaaagtaacaacattaccatctacttttgctaagtcacttaaacggatttcagctacgtgtaatgctttaagagaagtaaaaccaaattttggtaaacgacggtataaaggcatttgaccaccctcgaaaccacgacgaacaccgccgcctgtacgagatttttgacctttatgaccacgaccaccagttttacctaaaccagaaccaataccgcgacctaaacgttttgcactgtgtttagcaccttcagctggagaaagagaatttaaacgcattctattattcctccactttaaccatatatgaaacttgattgatcataccacgtactgctggagtatcttctaactctacggtatgacgaatatgacgaagacctaagcctttcaacgttgctttatgcttcggtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctttatgcttcggtaaacgagcgatagagctacgagtttgagttactttaatagttttagccatattcaattaccccaaaatttcttcaacggttttgccacgttttgcagcaaccatttctggtgatttcatatttgctagtgcatcaattgttgcacgaacaacgtttattgggttagttgaaccgtacgctttagaaagtacgttgtgaacacctgcaacttctaatactgcacgcattgcaccacctgcgatgatacctgtaccttcgctagctggttgcataaacacgcgtgaaccagtgtgagaacctttaacagggtgttgtaatgtaccttcgtttaacgctacattaaccatattgcgacgagctttttccatcgctttttggattgctgccggaacttcacgagctttaccgtaaccaaaacctacacgaccgttaccatctcccaccactgttaaagcagtgaaactcataatacgaccaccttttacggttttagatacacggttaaccgcgattagcttttcctgcagttcaccagcttgtttttcgatgtttgacatctcaaattcctctattagaactgaagaccagcttcacgagcagcatctgctaatgattgcacacgaccgtggtatttgaaacctgaacggtcaaatgcaactgctttaatacctttttctaaagcacgttcagcaacgattttaccaacgactgctgccgcttctttattaccagtatatttaacttgctctttaattactttctcaacagttgaagctgctgctaaaacttctgagccattcggtgcaatcacctgcgcatagatatggcgaggtgtgcgatgcacaactaaacgtgttgcaccttgctctctcattaaatgacgtgcacggcttgcacgacggatacgagctactttcttatccatagtgttaccttactttactttttcttcgcttctttaatacgtacaacttcatcagcgtaacgtacacctttacctttataaggctctggtttgcggtatgcacgaatatcagctgccacttgaccgattaactgtttgtccgcagacttaagaataatctcagtttgtgatggacattcaccagttacacctgctggcaactcatgttcaaccgagtgtgagaaacctaaatttaatgcaacagtgttgcctttcatttgagctctgtaaccaacaccaactaattgcaatttcttagtaaagccttcagtaacaccgataaccattgcattaacgagggcacgagctgtacctgcttgcgcatctgcattaacgatacccgcttttggagcgaatgttaaagtatcagcttcgtattttacttcaactgcattgtgaatttcgcgagacaactcgccatttttaccttttactgttaatagctgaccattcaaagtaacttgaacgccggcaggaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacttttggtaactcgtctttacgtttataaatacgaagacctggacggcttacgcgttggatactttctacaactggtttgttttggaaatattttaaagtgatttccaattcaggttttgaaccttcaacaactttgaagctctcaacataaccttcttcagctaaaacgcttgcaatagcaacttttaacttagatgaaggcatactgattgcaactttattcgcagcttgaccgttacgaatacgggtcagcatatctgcgattggatcttgcatgctcatgtatttactcccatgattccaaattaaaagaggttattaccagcttgctttcttaaggcctggaatttcaccgcgcattgcagcttcacgcaccttaatacggcttaaaccaaacttacgaagtacaccgtgtggacgaccagtttggcggcaacggttacgctgacggattggactagaatcgcgtggaagtgtttgtaattttaacactgctgcccaacgatcttcgtctgaagaatttacatcagaaataattttctttaactcttcacgtttagcgtagaatttatcagctaatttcgcacgttttacgtcacgtgcaatcattgattgttttgccacgataacctaccttatttacggaatgggaaattgaaagccgctaataaagcttgaccttcttcatcagttttcgctgtagtggtaatagtaatatctaaaccacgaacacgatctactttatcgtagtcgatttcagggaaaatgatttgttcacgaacacccatactgtaattaccacgaccgtcgaatgatttcgcgtttaaaccgcggaagtcacggatacgtggaacagcgatagtaatcaatctttcaaagaattcccacatacgttcaccacgtagggttactttgcatccgattggatatccctgacggattttaaagcctgcaacagatttgcgtgcttttgtaattaaaggtttttgaccgctgattgctgttaaatctgctactgcattgtctaacagttttttgtcggtcaatgcttcacccacacccatattcagggttatcttttcgattcgtgggacttgcatgacagatgagtagttgaattttgcttttaattcattaactactgtatctctgtagtaatcatgcagtttcgccatcgcattactccagttaattaaattgttttctcgttagatttgaagaaacggacttttttgccatcttcgaatctaaatcctacacggtcagctttatttgtttctgggttgaaaatcgcaacgtttgacgcatcaatcgcagcttctttcttcactaaaccgccagctttgcctaaagcaggaactggtttttcgtgtttagtgataatgttgataccctcaacaaccactttaccgtttggtaacactttagttaccttaccacgtttgcccttgtctttaccagcaagaacaattacttcatcgttttgacggatttttgcagccattacattctctccttatagtacttctggagctaaagaaatgatcttcataaacttctcagaacgaagttcacgcgtcacaggtccaaaaatacgagtaccgattggttgctcagtgttattgtttaaaattacacaagcattgccatcgaaacgaataactgcgccatctgggcgacgaacacccttcttggtgcgcacaacaactgcttttaacacatcaccttttttaactttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcgtggaattgcttctttcacagtaactttgatgatatcgccgatagcagcgtaacgacggtgcgatccacctagaaccttgatacacattacgctacgagcccctgagttatcagcaacatccagcatagtctgttcttggatcatattagtgctccgttaaaataaaaaacaccctttcgggacgaacctatttaccctatgcaaataggttgcggattatatcgcaattagcgtaataagatcaactgaattttattagaatgcattagagagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagagagtaggagttctcctcattcactactttaaaaaagtattaggattaataatcattggcgcaactattttacatgaataaaaacaaccaaattttgtgacccatctctcaataacatcgcggaagactaggcatttttgatattctatgattaaaatgcacttatttattttatcgaagcaggctttatgaaagtatcttccattgctattttagtcagtttattgagtttaaattgttgggcgaatgatgaaattgttcgttcccaacaagaaaaccaacaccaattacaacaaatccaacaacatcaacaatctcgttgggtttcccaacatcaattccaaagccagactaaagcacaggataacagtacggcaaccgaacattattgcttacgttacaataggttacagataacgggtgtaactttaatcgatcccctttcatttcagccattgccctacgaatgtttaaatgaaaaccgccttaatcaacttagccgagatttaacgcaagcctatttggataagggctatattcacaatccatttcaatttgaagatgatggttcgaaaacgctgattttacgagtaaccgaaggcaaagtggctaaattgacggggggaagttcgcaagtaaacttagccatgctgtttcctaacattgtaggtcaaccattaaatatcaaagaattagatcaggggctagatcaagcgaatcgtttgagtagcaatcaagtttctgtcgatgtattacctgccaaaatggcgagatcgaactctcttttgtcaataatccctcgcctgctgtttccggttatattggtgtagataattttgcttcacgccaatatcatcgttggcaaagccgtttcgggttaaatgtagatagcccatttggactgtcagatagcctttatttgggcggaagccacacgttaaaatcgacaccggaatttaatcgctctgcaattttatattattccgtaccttatgggcgttggacctttaacagctttggttctgtttcgcaatttcgccgacaaattccgttggtttatcataatgtcgagcaaaaaggtcgaacgtggcaggctggggtggaagttgattatgttgctcatcgaggggcaaaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaccatatttccacaatttctgcacaagtagaacatctgaatagtaaaagtcgttttgaggacagtgtgatcgagttacaaagccctaaattgagcgttgcacaattctcttttaaccacttacagctactgtcgcaaggttcgttgatctttaaccttgattatcgtcggggattggcttggtggaatgcgattaaaaatcaaggacgagatcagcctgaagggcaattccaaaaatggagtggcgatgtacagttgagttactttcatttgttaggttcgcaaaaattccgccaatctcaccgcttgtttggtcagtatagttcaaattatttgccagccacagaacaagcggatttattaggacgatatgcagtaagaggcttccaagatttatcgctctcggcagaaaaaagccttgttatgcaaaatacgttaagttggttaaataactatcgatctttacaaatagagccttacgccttgtttgatctgggggtacagaaaaatagcagtgataacgctcatagccaacgtgctttcggctatggtgctggacttcagttagctaaaactacgtggaagtcggatattcaatgggttaaaggcaaaatgcaacgagaaaaaacacagatgtgggaaaaagaacaaagacggcaaattaaccgttcaggtggaagaggcaaaagatgttttagttcaagctggcaatgcaaatgttcaggggaaagtgaccgctagcacccactgtcaacataaccactacactgcagacaaaaacgttaaagtagaagagtaccgttccagcaaaaatgaaaaatatcaagcaaccaaaatccaagcggataatcttgttgtcgatgtggataaccgtttaaatgtttctggggcagatattcaagcgaaacaagcgagtatcatcggtggtcaaacccattttggtacacaaatcacaacgaacgaaagtaacgcacgtaaacatcaatctaaaggtctttggttccgtgaagaaaccgataaaactaaagctcaaactgttcaccgtaccactgtgactgcagataaactcaatgtggtagcaacaaaaggtcaagtaacggggaatgcggttaaattagcagggcaagatgcttttgtttatggtgataaaggcgttgcattaaaaggtgttacacaaacaacacaagctgaagcgacaagcaaatttaaaaatgaaactgcccgcttgcgtacaggttctagttcacaaacagccaatacccaagcgttagtggcaagtgaattacaatttaaaaaccttaccgtaggtggcaacgatgtacatttgagtgcggtgaaaggtcaaattgacggtcaactctttgtgcaaaataaaggtaaagctgaatttgtcagccaagcgaccaaaaacacttacaactgatttcaacaaaaggcattaacgtgattggtagtaaagtgcaagcggtgaatactttaggggtttatgcaccaaccgttgaagtgattggggcgaaaaaccaaagtttatcaatgaaagaagaagctggatttggtatttccgcaaaaggcgataagccaaaagtgacctttaataccgaagcggcactacgtggtgttatcacatcactgatcaaaggcgaatcagtaaacgcacttaatgttgttaaaggcaatactcaatttgaagcacaaggcagcattaccttaggcatttataaccacaaacaacagaatagccaaacacaaactgcacaagcgagccaattaagtgcgaaacaaaacctcactttagaggcagagcgtattcaacatcaaggttcacaactttctgcaggcaataacattgcacaaggtgcagaacatatcgaacattctgtggcaacgaactcacaaaatgatcgcaccaaaaatgtggacgtaggattgtcggtcacttcatcgatcaacaaagataaagcgatcagcagttctgtcaccttatctgcttcaggtggtcgtgaaaacagccaaagcaccacagcacaagcaacgactctcaatgccggcaatagcattgtgatcaacggtcaaaccttgcaagatactgcaacacaatatcaagctggtggcgatttaacccttaactctcaacaacataacttacaagcagccgtaaatagcagcagtaaagatacaatgaaggcaggggtaaatatcggcgttagtggcaacacgagcgacctcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaacacgagcgacctcaaaaccgttaatctgaaagtgaatgtaggtgcaaattaccaacaaaatcagaccgcttctgagcaagctcaaaaagcctctttaactgcgaataacattgcggtaaatacaaacacgctttacagccaagcggatatgaaagcagatggcaacattaacgtggtggcgaaagagagtgcagcctttgctcaagcaacgaataaagagcaacaaaatggcgtaggctttaaagcagatcttggcgtaggggcattagtcgttcctgccgcaagtgctgctattccaagcgttgatgcaagtgtttcagtaaatgccgtaaatggtcgcacacaagatgcggttaccgctaaagttgaagggcaatcaatcaccattcaaagcggtaaaaatacgctagtacaaggcacaagtttggcggcggacaacatcaacttaagcggtgagaccgtcaatgttgtggcagcgaaaagcgataaacaactcactgatgttgcagtgggtacggcaatatccttaggtaaaggtgcatcaagtttaggcttaaatgcgaacttgaaagtacatcatgaagtttctaatagccatactgcaagtcaagttaccgctcaaaatctgaatattcaaagcagaaatgacattacccttactggcgtacaagcagatgcgaaaaatgtgaccctaaacagtggcaatggcaaccttgctttaaccgctttacaggataatgtgaagaaaacaggcgtaggtgcaacactctcattaaatggtggtgtagcagaacaaaaatggacaccaaatggcggcagtgcttcccttgatgtgaatgttattcgcaatcaaacccacacaagtaccgtagttaatagtgaaactgcgaacctcaatgtaggtggtaatgcactcttaacaggtagtgcattaaatgcggacactgtttctggtactgtgacaggcgacttaatcagcaaaggacttgtgaataaagtcagcgaaacaagtgtgagcgtttctgcaagttaaaccaatccaacataaccatcattaaataagtaagataaattagggaaaaaattgaattaaacggaataatgtgaaataaaaaatgaaaaggcattacacatagagaaataaaaaactcagccgagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaatatctttttctgcctgctcaatggtaactgtcgttttctcgttgttagcactgtctttcttctcaaaagacacttccaacttagtattatcaccatgaggacgagcgaccatatcaccattactgagctgttcaagagaaggtttatctgcaacaacgtcttgatcttgacggagatcgctgcctacggtaattgatgtattagaggtgactcgatctggttgaccatttgccccttgtgttttttcaaccgcatctttaccttctgctggcaatcctaacgcattgtagcctttggcagtcacaggggagtcatccttaaccgcatttgcgttaagggtaatcttgcctgtgttcggatcaatagttgcaataccagcatctttagcagaaacaagtccaacaccctgtggattgctagggttttcgccgttgtctgccggtgctgtttgtgcttgttgtaacttctcataatctgctttggttgcagcaaagagtccccaaacaccattaactttctgagccactaacaccatatctatatcttcattgactgatgcaccatcctgagatttcactgttgggataggctgattattggtgttggttgaatatcccggcatcgctggcggagtcatggtgtagcctttgaaggacacaacaactttctcattatccccttgcggttcaatgattgcagtaccttgttgataggtattatccttacctttcaccaaatgaggcgcatcagcttctttcggtgtagtatcatctaccaacgccttaatcttggcttcctgtacggttgtcaatctagtgccgttttctgttgtatcactagtttcataaggtttgtttgatgctactgattcatttccaacagtcttataaccaatcgcttctgcttccgaaccatccttcactttcggacctttaacaattacagtaccgtcttctttgatgatatagtcgtccttagcaggttttttatctgcatcagtcggatgtgtttcatccaacacccacttaccttgctcaagatctttcttcacagcaatttctttatcctgaccgctattatccttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtgcagaatgcattgttttataagggatattggtagagatgtggtgttttatttattgtattttcttttgctataatacggtttcccatgtttttttgaagtggtttaattcatgttaaattttgaaaatttaccttctcttcttacaggaaagagcagacagcatttggttaccttaccaaataaattatctgatcagcatgcattacaatctgaagtagtaaaagcatttttgcatttacaagatgccgcactgaaagcaggttttaatttacaacctgcaagtacttatcgggattttgaacgacaaaaatggatttggaatacaaaattcaatggtgaaaataaagttcatgatgatcatggtaaagctatcatattaactggcttagatgattgggacaaatgtcaagctatcctgcgttggtccgcagtgccaggggctagccgtcaccattggggaacagaaattgatatttttgatcctactttacttcctgaaggaaaaaagctcatgttggaaccgtgggaatatcagacaggaggctattttcaacatttaacgaattggttattagtcaatgccgaacgttttggtttttatttcccttttatggaagctaataataagtttattggtctagaaccatggcatatgagctatttccctatttcggaacaatatgagcgattactgtccccagagatgttgcaaatggcttggcaaggcgagaatatcgctggtgtaaatagtttgaatgagcatatttctgagttatttgaatattacattttgtaaatgtccctttctgcttttttattacttacagataattttcaagatcaatcaccttatcacaactccgttcaatcaaaaacggatcgtggctgacgataattaatccgcagtttctcgctcggcattgttcaatcagcaatttgatcgtttcttgttgggtgatcggatctaaacgagaagtcacttcatcggcaaacagtagcacgggttcaagcagtaaagctcgcaaaattgcaacccgttgcaactcgccacccgatacgttatcggcgttgcgttgcagaatgttaggcgacaatgcaagctgtgctaatagagctggaatttgtgaacggtcgagatgatgatgttcgatcacatcgtccaataattgttgcaagctcacattcggtgcaaaggcttcaggcggatcttgatacaatttcagcacttgatgttttttatggctgtggctatgccaaatcacttcgccagattgcggtttaagtagtccgcaaagtacgtcggcaagggtgcttttgcctatgccactgtatccgacaatgcctaaaatttcgccttggtgtaaatcaaaagaaagctgtttgaacagcgttcttgttccccgtgcgaccgttaaatttttgacagaaacaagcggtgtttttgacgtagaatgttgcaaatcagccaaaggttgccaatgttgcggatctgcaccgattaaggcttgagtataaggatcttgcggttggctcagcagttgttccgcttcgccttgttcgatcaatttgccttttttcataacaaaaatgtagccaccaagagcggtcgccacttcaatatcgtgagtgatcgtcagcaagctaccgcctgtttcataggcttgtttcagcaagttaatcacttccgctttgctattcggatcaagtcctttggtgggttcatcggcaagtagaattttcccccctgatgcggtcgctatcgcaaaggaagctctctgtgccataccacctgaaagttggtgtggatagcgttgttgagcttgagataaacccagttgagttaaagaaatctcgctcgccttttctgcgttcttttggcttaacccagcgacaaaacgaaaactttcccacagttgtcggctaattcgcatcagtggatttaatgaacggcgtggctcttggggcaacattactaaggttttgccccaaagagattgtaagcggtcggattgcccgtctattttgcaattttccactacaatctcaccgcttgcgattaatccttgcggtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtaacgctcccataattgcttgaattaacagactttttcctgagcctgtttcgcctaaaatggtgatatttttgccacgttcaagacaaaaactgatcggctcgaccagctcaatgccatcgagtgtttgaacagtgacgttggttattttgagtaatgacacggtgttttctctactatatttcaatggattttacattaaccttcgtactatgctacgtttgattcttcccccacttgtgggggaaggtgcccgaagggcggatgggggctatttacatttagctttattccccttttcccccatccccctcgctgtcgcttggggacttcccccataaatgggggaagtattttgataaggaaggaaatatgcacgatagttaatgttcaaatttacttcaccttaggaacacagcaattacaggttgtaggaaaatcaatggggcttgatagtaataggggaacagctctgtcatcatcagccctaattcagccgtaggcggtcgcaatcctacgttgacaaaccccagtgttgcaagggctaaaatcgcattaccgattgaaaatgcggttaatgtggcaaccatcggcagtaaacgggggaacagatgacgtttaatgcaataaaaccaaggcattcccatcaaacgagaagattgcagttctgagctggacgcaagggtactggtgatcgccctgatgacacggaaaaattcaacccaaatcactaaggcaatacctaaatagagtgtccaaaatgaaccaggggaaagcgaagcaaacagcaaaatcagcaataaacctggtaatgccatcactaaatcacagataaagctaaacaagcgatctaaccaaccgccaaataatcctgccagaatgccgaataacaagcctgccaccaatgcacaagcaacactaaatagcgataaaccgaatgaaaggcgaatggcggaggcaagacgggcaaacatatctcgccctaaatgatcggtgccaaaccagctttctgcatcaggacttgccaacatattgctgagatcttgaaaaccaatatccatcgggtagaaataaggctgtaaaaatgcagtggtgagtagcagtagtaataacaaagctccgcaacgttgtccaacggttaatttcatactgttcccccttcacgaatacgcggatcaatccacgcattaagcagatcggcaagcatattgagtaccacaaataatccccccatcactaatgccgtgccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttgtatcatcggcacatctcgtgcaatgatggcgtgaactaaagcgtgtccgcttcccggccaagcaaaaaggctttcgacaatcaccaccccttcaatcaggtaaaccagttgcacgctatgataagcaatcactggcacggcaatattcgggatcccatgtcgcacaaaggtctgccaacggctcaagccttttagctgtgcaaattgatagtagtcggattgcatcacctgcaccattgcttgacgtgtcacacgcaccgaaacggcacttaaacctatcgctaaggtgagtgctggcaagacaaaatgcaatgccgtgccgtatccgcctgctggtaaccatttcaactgaacggaaaaaagcgtaatcaacccaatcgcaatgataaaagcaggcacggcacgaaataaactgcttaagactaaggtcaagcggtcaaatacgccgttcggtttacgagctgataatacgcctaagatgggaccaatgagcaaggctaacagtaacgctaccaccgctagactaaaggtatgcccgaattgatgttcaatttcgtgccaaacgctgtcgcctgtgactaaggatttacctaagttaaactgcactaaatccgctaaccaactgccgtaggtttgccaccaaggttgatccaacccgagttctgctcgtaccatttctgcggcggcggcatcggtttgatcataaccgtagcgacttgccgcaatacgatatgccatatcgcccgacagttgccgagttaaaataaaagtcaaagtcccgactgaccaaatcaccaaaaggatttgggatagtcgtctgaataaaatagaaagcacggggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccaaaaagaaccgtctttcaaaaggatctaaagtcacatttttcacgtctttatgtgccaccacattttgctgatagtacaccacaggaataatcggcagttcatcgtggataatttggctcactgtctgttttaacgccttcgctttttgtggatcacgttctgtttcaagctgagttaaagcgttgtctaacgtcgcattttgccaattcattaccccccaatcacttcctgttttcgcataatcctgcacgatcacgccaaaaggatctaaggttttgccataatttaacgcataaagcgccatctctaaactgccgtcttggtgcccagcagggatttcactgaagttaccgacagacacattcacatcaacgccaatctgcttccattgagcttgcaaaattgtcgcaatcatcggtaattcagggcgatcggagaatgtgcgtagggtaaaactaaacggcttaccgtctttagttagcttgccttcgctattaaattcataaccgcgagcggtcagatctgctttgatttttgcaagatcaggttttgccgttgttgtatcaattcgccattccgcaaaggctttcggcagaatttgatccgcttcgcccccttcaatttttaacacatattccgcaatcgctttacgatcaatcgcatcacttaaggctttacgcaccgctaaatcattgaagaacggttttgccacgtccattttaagctgaatagtgcgagcaatagatacactggttaagttcaaatttggatcggttttcaaacgttcaacgctggcggtatcaaggttaaacaccaacgcagatttatcgctttgtgccatcagcattcgagtttcgctacggctacttgcaaggtagttcgcttgagctagtttcggcttattgccccaatactgttcaaaacgcaccgtttccaatttttgtggtgcttcaattttagtcgctttaaacgcccccgtgccgatcacttgggtcacttcccctttgtcgttatagctttcaggggcaagaataattgcggtgtagtgtgttaaaaaagatggaaacggcacaaaagatttggttaaggcaatttgaatttctgtcaggctgaccgcttgaatatctttaataaaggctttttgcaacattcccggtttcgccaatgcaatatttaggctgtttgccaccgcttgtgcagtcaaaggttgcccattgtggaaaatcacattcggacggagtttaaaggtccaaagggtcgcatcttcattactgttccattcggtcgccaatcctgcaacaagttccccctgtaaattcgcttccactaaggtttccgctaaattcatacgttgaaaaatcacccctgtctggttcggatcaaggctattgatttcccaaggggcaaccaccgttgccagagcaagttcatcattttgctttgtttgagttgtcggttcagtcggctttgccgtttctgttgctgtggctttatcaccttgaaaatagtgaaccgccaacgctgcaacaccaccgactaaaaatagagcaagaaattttttcattgttatatcccttaaaataataatggttttcaaaaaggtgtgtattgtgccataaattccataaaaaaatagtgggatgttaaaaaatttatcaccgaagagtgtgcccgtagagggattagatagtaactaagactatctgttcaggatcgatatgtatccatacctgttgattttcttggagcggttgagcttttttgaccgttgcgtaacattccgttccatttgcgtttaatgcaatttctttatattcccctttgtcgtaaattgcttcgactttggctgttagactgttcgggcgttgtgggtgttcggggtgaatttcaatccacggcgctttgaccattaacattacttctttcccttgtgtcagtttgagccgtgctgcactttgagctgtaatggaagcggtgagatcttgcggaaattctgcaatgtgaatatcaacgtagcaatgaacatcttcttctctcaattgggtgacagtgccaaaaaattggtttctggcactgctttgtagggagaatttggctgttgcagtgagtaagctatctagggggatgctttcatcttgaaggatcgcaaaggcttttgcttgggtctgttcaagtaaatcgtagagctgaagtaaccgctcggcatagggggttagggcagtgccgccgccgtgtttgcctcctgtgttgcgttcaagaagtggtttagggctgatgttgttcatcgcctcaagatgatcccaagcacttttgtagctgactttagcgttttttgccgcttggtttattgagccacattcttgaatggctttgagtagggtaatccgtttgggatcgacaaaaagctgttgttttagtttgatggttaataggatttcgttgtttaacataggctgcctttttgcaaaatagaacgctgaaattatctactttcttgtattaaaaggaaatgtaatttttatctttgtatttattttataattcgttatataatagtttatatattgttatatccactctaataaggatcatttatgaaaaaaacttttgtaaaattagctttagcgtcagcattggctttgggggctacttctgcgtttgctgaaaatattacggtatttgcagcagcgtctatgacaaatgtgttgcaacagattggtgatgagtataaaaaaacttatccagaggatagtttgaccttttcttttgcggggtcttcaactttagcaaaacagattgagcaagatgcccctgcggatttgtttgtgtctgcggatcaaaaatggatggattatgtggctgagaagctgcctgccaaaacaaaaaatgtgacaacgttggttgaaaatgagttggtgctgattgcgcctgcagacagtaaaattaaagtggcgtctattaaggatattaactttaaaaaggtgatcggagatagctatttggcagtgggcgatgataatgtgcctgttggtcgctatgcgaagaaagcgttggaacatttaggcgtttgggctgatgttgagcctcgtttgtctaaggcaaaagatgtgcgtgcggtgctttcttatattgagcgtggtgagttaccgttggggattgtgtattcaaccgatgcgaaagtaagtgataaggtgaaagttgtcgcggttttccctcaagagagttatggcaaggtggtttatcctgcagcaaccttaagcgataagcctgaagcaaaacgtttcttagactttttagcgacaccaaaagcgaaagaggcttttgcgaaagctgggtttaaggcagttagataaccttcggatttgacctgctattagtgaggtgagtttatattccctcctactatagcgtttatctttgatattccacccatcctttttctttatcttcccccgcttaggggaagataaagaaatcgtcaaacataatgatattgagtgaaaatagattcactatttccttttctgggcttcattttccatttgttctacacataagtgaagaatttgatccgcaccttcttggatatatttatcgtgacggactttattggcttgaatatctaacattgcatcatagataccctgtgtaatacttggtgtttgaaccattgtccaacaggttgggcttagacgattaaaattattttgtagctcggcagcataaagtacgccgctataataagcatacacattatgatctaacattcgatttaacaggcttgcccgaatttgttctatcgggtgcttaactttcttgttaaaccaatcatcaaccccacggataaaagatgtaatatcatagctttcatttacgcgatctgcataagtttgccctgttgcaccataagcaatcgcataggatttttgatcgatttgggactcgggtaaacgcttccaaccgcttgtattagtgctacaagctgttaccaatatcaacgtaaaaatgacagcaactcgtttgtataaagatttcatcatttactccttatctctctgtactaaaaaagtgttacaattctaacaaattattttgcggattactctaaacattttaaggttgaattatgaaacaatatcttgatctctgccaacgtattgtcgaacaagggaagtgggttgaaaatgaacgtacgggtaagcgttgtttaaccgtgattaacgccgatttaacctatgatgtggcaaagggtgcatttccccttgtgactacacgcaaaagtttctggaaagcggcaattgcggaattactcggttatatccgtggttatgataatgctgcagatttccgtcagcttggcacaaaatcgtgggacgcaaatgccaatgaaaatgcagcttggctggcaaacccacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaacccacatcgcaaaggcgaagatgatatggggctggtttatggtgcggtcgggcgaaacttcccgaaagttggcggtggtagcgtcgatttattacgtcaaattgtcgatgatctgaagcgtggtgtcgataatcgtggtgagatttatacgttctatcacccaggggctttccatatgggctgcctacgcccgtgtttacacagtcatcatttttcattgctggatggcacgctttatttgaacagtacccaacgatctgccgatgttccgctcggtttaaactggaatatgatccaatgttacacttttcttgcgttaatggcacaaattacaggactccaagcaggacaagcgttccataaaattgtgaatgctcatatttatgaagatcagctggaattaatgcgagatgtgcaactgaaacgcacgccatttaaagctccaacactcaaaatcaaccccgatattaaatccctagaagatttagaaacttgggtaaccttggcggattttgaagtcgagagctacgaatatcatccgagtattcagtatccgttttctgtgtagttggaaaaatttttgctatcttcagactttattatttctctttatataaatgattggaaggtaggatatttgaaaaagtgtgcaataatttcctaaaaaatcatcgaacaatagaaaatcgctgatttgtgtttgacaagcatataaaaatctctaaaatacgccgcaacgaatatgttgtgttaagcaatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgataaaaactgcatctatcacccatcttcttttctagatctagataaaaagttttttctattccattatttactctttttcctttctatttagaaaatctttgcaatatctttaagataatattaaattcaacttgattatagtttggcgtgatttctataaatgcgatattagctttgcgacaagcctccctttttattgcatctctttccgctgcattatgttgataatgagcgtgcccttgatattcgatgactgcaataggattgctttgtttatctgtgataagaaaatcaacccttttgtgattaatttttgcataggcttcatcctgttccgctttgataaactcccccatggcgacttgagaaaatagaagaaaatgtgaatcaaggttgtgtgattttaggtaatttaataaaagatagaataaacgatgttcacttttgttcattaatgggactttatggtaactcgacttagcaactattgctaagttggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatgtgtaaagccttttgggaatatcggagtatcaatagtagctctcctagataatgtcgttcttttccggctattagatatggttattccaaaagcaaagatgagtatggcactagcaataatgagtaatagctgactgtgttcaaataaataggtaagagacattgcgtactccatttgtaaatataaagttgtcataaagtaaaaaaattttgtgattgctgcaattggattcttttaatttttcgacagagatcgaaaaatttattttttctcatagcaaacgtttgcgtaagtcgatataattattctattctttgtttagatattggaactttgttatgcaaatcagcctaaaaaaaatctattctggtaaagttcgtgatctctacgaaattgatgataaacgcatgttaatggtcgcaaccgaccgcttgtctgcttttgatgtcatcttagatgatccaatccctcgtaaaggggaaatcctgacgcaaatttctaatttttggttcaataaattagcccatattatgccgaaccattttacgggagattctgtttttgacgtgctaccacgagcagaagcagaagctattcaacatcgtgccgttgtttgtaagcggttagtcccagtaaaaattgaatctattgtgcgtggctatttgacgggtagtggtttaaaagattatcaaaaaacagggactatttgtggtttgacattgcccgaaggtttggttgaagcaagcaagttacctgagccaatttttaccccttcaagtaaagcggaagttggcgaccacgatattaatatcagctacgctgaatgtgagcgtcagattggggtagagctagcggcaaaagtacgagatgcagccatagcactttataaaaaagcggcagattatgctttaactaaagggatcattatttgtgatactaaatttgaatttggtttagatgaaaatggcgtattaacattgatggacgaagttttgacccctgactctagccgtttttggtcagttgaaacctatcaagaaggaagtaatcccccgtcttttgataaacagtttattcgtgattggttagagcagagtggttggaacaaacaggctccagcccctagtgtgcctgctgatgtgattgaaaaaactgtggcgaagtatcaagaggctttggaactcttgactcaataggctgtgtaagcggtgaaatcattgcaaaaatttcaatattatgtagcaattgcataaacatttaattttttgtaggggcggggaaaaccttacccctacataaattttcttaatatagatcatcgtaaatttacttgatcttttctttttaaagcgtatcatacgtcctcttttttcacttgggttccctcaccccaaacaaccaaacttatataaaaaggaacaatatgaacgtatttgattacttttctgacgagcagaagcgtcgctcgttgctattactttctctttttcacatatttatcatcacaatcagtaactatttagtacagattgcgtttgaaattccaatcccttttactcaaacgacgatcccaacaacttgggggacttttacctttccgtttatctttttagcaacggatttaacggttcgtgtatttggtgcgtcacttgctagaaaaattattttagcggtaatgttgccagcattgatcgttagctatgtgatctcggtgattttctttgaggggcaatttcagggagtagctacattggcggagttcaatctatttgttttccgtattgcattagcaagttttgcaggttatgtggtgggtcaattaatggatatttttgtctttaaccgcttgcgtcaaggcaaaacgtggtggcttgcccctgcaagctcaacgattttcggtagtttaattgatacatttgtgttctttgcagtggcattttataaaagtagtgatgaatatatggcggaacactggtttactattggagcagttgattatgcattcaaattgtttgtcagtctgttgctctttttaccgctctatggcctagtacttaattttttaattaaaaaattaaatttaaaacgctttaattaagtaggcttcttcccatccttttggatgggaagaaaatacctccttacttgtttggcgcttgccccaatattctcgtcaataattcccaataaatttcaacagcaggaatatgcactttttcatctggagaatgggcattacggattgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacggattgttgggccaatagaaaccacatcaatgtttggatagactttcttaatcaagccacactctaggcctgcgtgaatcactttaatttgagattcatagcccagtatttcatcataaatcgctttggtaagtggcgtaatggcggatgttgggtctggttcccaacctggataaccaccagagaaagtggctattgcaccgaccagttctgccaatgaagttaaacgagaacgtacgtctgctttgccgttttcaattaatgaacgcactaaaatattcgcttttaccccttgttcatcgctagtcaaaatgccaatgctcaatgaagtttctaccacattttcgaccacatcgctattgcgaattacgccgtttggtagcacgttgaggaactgaatgactttctcactgctctctttggcaaaaatctgtgacggcttggcaaccttttccacaataaaatgtaaattaggttcagcaaaagctaactcacgttgcaatgcctgttcaaactgacgcaaataagcggtcagattgtcttgatcttttgcattaaagccaatggaaacgaccgcttctctaggaattgcattacgcacggagccaccacgaattgcaccgatttgaaaatcaaaatgcgattttaactcagccaacgtacgagctattagtttaatggcattagctcttgttgtatgaatgtcacagcctgaatgtccgccatttaagccttttagacttatctgtaaggttgtatcaaaaggattttgttcatagttcacaggcaaggttaatgttgcatcttcgccacctgcacaaccaatgtaaatttcaccgttatcttcggtatccgtattaatcaaaatgtccgcttttagccaatttggacgtaagcctaaaaccccttccatacctgcttcttccgtcattgtgagcaaggcttcaatttcagggtgaacgagatcatcagcgtctaacactgccaaacaagaggctaaaccgatcccattatctgccccaagtgtcgtgccttttgctttgacccattcgccgtcaatataaggttgaataggatcttttttgaaatcgtgcaatgttccttcatttgcttgtggcaccatatctaaatgtgcttgcaatgccactgttttacgatcttccattccttttgtcgcaggtttgcgaattaaaacgttgccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacgttgccagcttcatcacgttctacaaaaagctgtttttgctttgcccagttcacaataaactgagcgatttcttcttcgtggtaagacgggtgtggaatggcacagatttgatcaaaccatttccataataagtgaggtttaagtgtttgaatttctgacatatcggtttcctataaacaatgatagcggtgagtttcctgtaaaattttgcaaaattcattcggataaatacgtttattgtaaaatttgccttgaaatgatagcacgaaagttgttttcgggttatcatttcgcaatttttttattcggtggcatcgccaccgctttttttaggtgaacttatgagtgagaaatacacaaatgaaaaatatgttgtgacgtgggatatgtttcatatgcacgcacgcaaattagctgaacgtcttttacctgcatcacaatggaaaggcattattgccgtcagtcgtggtggtttattccctgctgcagtattagctcgtgaattaagtattcgccacatcgaaacggtgtgtatcgcaagttatgaccacgatcatcaaggtgaattaaaagtattacacgctgcacaagttacaaatggtggtgaaggttttatcgttgttgatgatttagtggatacagggaataccgctcgtgctattcgtgaaatgtacccgaatgcaaaatttgtcaccgtgtttgctaaaccaatgggggcagagttagtagatgattatgtggttgatattccacaagaaacgtggattgagcaaccttgggatttaggtattacctttgttccaccactcgcaaaaaaataaaattcagtgttagggacgcttttgcgtccttaattttttacgctattatttacataaataatcgtagggacacactgcgtgtgtcccaggctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtccactctatttttagaatttgacagtagcggacacacgcagtgtgtccctactgatatataaaggacaacaatcaatgcactttgaaagacgtagccactggagtggtgaactaggacgtgaaatgcatttcaacgtctatggacacgcaggcaaaccagttatcgtattcccatcatcaggtggcaaccaaaacgaatacggcaattttggtatgatcgaagcctgccgttcttttatcgatcgtggcttaagtaaattctataccccagactcttttgacagcgaatcttggcttgcagaatggaaatcgggacacgatatggcacaggctcataacgcttacgaccgttatatcatcaatgaatttgttccgttaattcgccacgaatctcagtgggagggagcaatgatcgcaacaggttgcagtatgggggcttaccatacgatcaactttgcattacgccacccagatctgtttgatactgcaattgctttaagtggtgtttacgatgctcgtttctttacaaaagagttttacggcgatcttgcaattcacattaattcaccgattgattacctttggaatcaacacgatagctggttcttagatcgttatcgtcaaaatcattatatcgttgccgtaggacaaggtgcgtgggaagctcaacacgttgaagacactcgtcgtctgcaagatgcctttgctagcaaaggtattcaaggctggttcgactactggggacacgatatggcacacgactggcctttatggcgtatgcaaatgccttatttccttgggaagttggaagagcagggaattatttacacctgattctctacgggctgtaaatccaacaaggatattttaaatggattattttcactataaaaaccaacaacttttcgcagaagatgtcgccattacagacattattgcgcagcatggcacaccagcttatatttactctcgggcaacacttgaacgccattggcatgcttttgataaggcatttggtgatcacccacacttaatttgcttcgcagtcaaatctaactctaaccttgccctgctaaatgtaatggctcgtttaggctcaggctttgacattgtttctcaaggggaattagagcgagtattagctgcagggggggatgcaagtaaagtggttttctctggggtggcaaaatcgcatagagaaattgctcgtgctttagaagttggcattcgttgttttaatgttgagtcggtttctgaattaaaacgcattaacgaagttgcaggacaacttggtaagattgccccaatttcattacgtgtaaatccagatgtcgatgctaaaactcacccttatatttcgacagggttaaaagaaaataaatttggtgtaagtgtcaaagaggctcgtgaagtttatcgttttgctactaccttacctcatgtaaaaattacaggaatggattgccatattggttcacaacttaccgaattacagccatttttagatgccactgaccgtgtgattgtgcttatggaacagctaaaacaggatggtatcgaactgcatcaccttgatcttggcggcggcttaggggtgacttatacggatgaaacaccgccacacccaatggaatatgctgcagcgttgctccataaacttcgaacctacccaaaccttgagatcattttagagccagggagagcgattactgcaaatgcaggcattttagtcactaaagttgaatatattaaacaaaatgaagatcgacgctttgccattgtagatacagggatgaacgatatgatccgccctgcattatatgaagcgtatatgcaaattattgaagtaaaccaatcgcttgtacgtgaaaaggcaatttacgatgtcgttggtccaatttgtgaaacgtcagactttttaggtaaacagcgagaacttgcaattgccgaaggggatctaattgcaatgcgttctgccggagcttatggtgcaacaatgtcctcaacttacaattcacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttacaattcacgtccacaagctgtagaagtgatggttgatgctgataaagctcacttaattaaagctcgagcaagttttgaagatttatggcgtttagagaatatagtgcctctttgtaattaatttcattcggagtatttaatgcaaaagcaaccatctatttttggcggtgcctgtatcattgcaagtgtatgtgttggcggcggaatgttaggactaccgagtgctggagcaggagcatggacagtatggactgcagttgtaatgttaattacaatgatagttatgacgatttctggtgcaatgctacttgaagcatataaaaattatgaccttcgagtctcttttaacacagttactaaagatatactgggaaataaagtaaatataattagcaacatttctatctactttgtgggaggtattttgctatatgcatatataacctctcttggatatctatttcaagatttgcttaatatcacaaatcaactatctgctattatttgcgttttagtcttcggcggattagtttggcactcaactcgagctgttgatagaatttccatcattctaattatttttatggtattgagcttcatctttagcatctggggacttgctactaatattaatttttcctatctttttgatactgtcaataaagagcaaaatgcttatgcacagtataccatgatgatgttacctatagctctgacttcttttggctaccatcattcagtctcctcaatgagggcatactacggtgaagaaaaaagagcatctaaagccataatttatggaaccatgattgctctggttttctatctaatatggattggttgcgtatttggcaaccttccaagagaaaaatttacccctgttattcaaaatgaaggaaacattgatgtactattaaatacattaggcaatgtaataaatacactaagtataaagcaagcactcaatgcattttctatcgcagctattttatcttctttcattggggttggacttggagtttttgactttttagcagatctcttccaattcaaaaacgataaattaggtagaacaaaaagttggtttgccacatttataccgcctctcctattatctttactctttccatttggatttatcactgccatcggatatgctggagccgtggcaactatttggacatgtattattcctgcgttactaatatataaacaacgccaaaaaacaagactatatggatttaaagcttttggtggaacaccaatgatttggtttattgtcttatttggagtcttcgttgcgattttccacatcttaacaatgctaaagatgttacctatattcataggatagattatagatatggtctatagctaatttaacattcaaaataacataatgaaaaatcaaaataatttcctacagcacacgccaatgatggctcaatatctccaactcaaagcacaaaatcccgatattcttctgttctatcgtatgggcgatttttatgagttattttacgacgatgccaaaaaagcggctgcgttgttagatatttctctgactaaacgtgggcaatcagcaggtgaaccaattccaatggctggggtaccgtatcacgctgttgaaggttatttggcgaagttggtggcgttgggtgagagtgtggcgatttgtgagcaaatcggcgatcctgcaaccagtaaaggccctgttgagcgtaaagtcgtacgaattatcacacctggaacggtcagcgacgaagcgttgctaccagaacgccaagacaatttggtcgccgcaatttatcaagaaaaaggcgttttcgcccttgcgacattagatatggcttctgggcgttttttgattagcgaattacctaacaaagaggcactgtctgctgagttacaacgcacccaacctgccgagattttgtatcctgaagatttttctgatgtaggtattttacagggttacaaaggcttacgccgccgacctgtttgggaatttgagctagttacagccattcagttgcttaatcgccaatttgggacacaaaatcttacaggttttggagtagaaaaggcggtggttgccttgtgtgcggctggttgtgtcttgcattatgctcaagaaactcaacgcaccgcactgccacatatcaacagcattcatttggctcaaaatagcgatactgtcttacttgattcggcaactcgcagaaatttggaattaaccaccaatctggcaggcggtacagaaaacacacttacatcggttttggataaatgcgtcacctcaatggggagtcgtttactcaaacgttggatccatcaacctattcgtgatttagccaaactgcatactcgccagcaaactattttggcattgcaaaaaaatgaacgtatcgaaccgcttcagcccctgctacaacaagtaggcgatatggaacggattttggctcgcgttgcattacgcactgctcgccctcgtgacctaacccgtttacgcacagctttagagcatattcccgatattgtaaaacattcacaacatcagaccgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacaatactttgcagcagatcgccgattttagcgagctattcgagctattaaaccaagcaatcattgataacccaccgcaacttatccgtgacggtggcgttatcgccgaaggctacaatgctgagttggacgaatggcgaagtttggcagaaggggcaaccaaattccttgaagatttagaagcgagagaacgagccaaaacaggcattgatacccttaaaatcggattcaatgcggtacacggctactatatccaaatcagtcaaggacaggctcacaaagctccgatccactatgtccgccgtcaaaccttaaagaatgcggaacgttacattatccctgagctgaaaacctatgaagataaggtgttgaaagccaaaggggcttctcttgcccttgaaaaacagctttatgatgaactgtttgaactgttaatgccacgtttgggtgaattgcagttggcaagctttgtgttagcagaacttgatgtgctgaccaaccttgccgaacgtgccgaaagtttgaattatgtaatgccaagtttcagccatcagcgaggcgtgaatatcaaaggcggtcgccaccctgttgttgaacaagtactgaaaacaccgtttatcgccaaccctgtactgctcaatccacaacgccatttgctgatcgtcacaggtccgaatatgggcggtaaaagtacctatatgcgacaaattgccttgattactttaatggcatatatcggcagttttgtgcctgcggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgcagaaatcggaccgattgaccgtatttttacccgtatcggtgcttctgatgatttagcttcagggcgttcaacctttatggtggaaatgaccgaaatggcgaacattctgcaccaatccagcgaaaacagccttgttcttgttgatgaaatcgggcgaggcacctcgacctacgatggcttatcactcgcttgggcgtgtgccgaatggttagcgaagaaaacccaatcgctcaccctatttgccacccactactttgagctaaccagcttaccaaaccagctcaaaggcgttgccaatatccatttagatgcgttggaacataacgacactatcgcctttatgcacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatcgcctttatgcacagcgtacaagaaggggcagcaagtaaaagttatggtttagccgttgccgccctagcaggcgtaccaaagcaggtgatccaacttgcgaaacagaaactcacacagcttgaacgactttcgcaacaaacggcacaattagacgcaaatcaacagcaagatttactcttttcggcgaatttgcaaaatgctgaaccaatctcaccgcttatcgaaccgtccaaagtcgaacaagccctcgcagagattgatcccgatgaactcacaccgaaacaggcgttggagatgttgtatcggttgaagttacttataaaataaagacaccttggaatgtagacaaaattggagattataataaaaagccccatttctaactgctcaggaactataaaacggcactaagcctttttatcattgaatttactgagtttttgaatgatcacatttaaattagtatggggctttacctagaatgtgagacaggtgttagataaaatgtaagtcatcttttcctcttttcacgacccttgtataatagctgagcttttttaagcaatgacaatttattttatttcagatatcacaagggccttattatgaaaaacatcttaacttggcctgtggttgcaggtgctgcacttggtatcgttgggctgcttgcgggtgtttttgcagggattttcttcttcaaacgtggattttcgctcggtaagtccggcgaacaaagtacagcatccagcatagtccctatttttattgtgatcgccctgtttattgccctgatcacccaattccgctttggtgaaaacttacccattttcttctctgaaaagcccctgccgcccaacatgccaacctatggctttcattaggtgctggtgtgcttgtcggtatcgttatgcaacgctctcgtttttgttcaatcggtgcattccgtaattttatcttatccaaagacagctatctgctaaacggaattgttgcattggtggtatgtacgtctataaccaacctaatgctgggtcagttcaaacttggttttgaacaacaaccaattgcccataatgatgttgtatggaacttcctgagtatgacactgtgcggcttatgtttttctctcgcaggaggctgcccaggtaaacaactggtgcatttaggtgaaggtaataatgatgcggcacttttccttgtcggaatgctattaggtgcggctgcagctcataatttttcgctggcagcatcaggtacaggcatatccacctttacaccttatggggttggacttgggctgcttttctgtctctatattggatttaccaataagtctactcattagaactagggtactgtgccttattaatgaaatactgacgtacttcaggtacagtacccgattatacttaggttatattttctaacccaataattgtgagataagtctaaagactctatactgaatcagtatagaatctttagctagcggtcatcacaaatgatagtatcgcaaaactttttaattaatgattacatagaaatttgaaccattacgcaaaatatttaaggcaatggcagatggattggaatcaagaaccttacgcaactcgcctaaattctcaacggtacgacgatttacaccaacaatcacatcgccttttctaaatcctcttgcctcagcgagtgaatttttttcaactttagtgatttcaacgccttttattcctttttcgttatagtttgaaaactcagcaccatttaaacttggtaataaacttttcgcacttgttttggtttgttcgtcagattgtaatgtgactttaacatttttctctttaccatcacgtaaataggttaattcaatttctttgccagctccagtagtcgctacttttgctcttagttctgcgaaactacggattttttgaccatttagccctgtaatcacatcacctgctttcaagccagctttagctgcagcagattctggcatcacttcgctgacaaaagcaccttgttgtgcattgacatcaaaggctttagctaaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttagctaaatctgcattgagttcaccgcctttaataccaagtaagccacgcttcacttctccaaactcaataatttgctgaacaagattgtttgccatattacttggaattgcaaacgcaatacctgcattaccgccacttggtgaaataatcgcagtattgatgccgattaattctccatttaagttaattaatgggccgcctgagttaccacggtttactgccgcatcggtttgaatataactctcatacccttcatcaatatcgcctgttgaacgacctaatgccgatacaataccagatgtcaccgtttgacctaacccaaatggattgccgatagccacagtgaaatcaccaacacgcaatttatctgaatctgcaattttaatttcagttaaatctttaggattttctaattggattaatgccacatcagacattgggtctgccccaactaatttggctttaaattcacggccatcttctaatttaacggtaattttatcggcattatcaataacgtggttatttgtaactacatagcctttcttcgcatcaataattacaccagaaccttcccccttaaactgacgaggagaacctccatctctaaacatatctggaccaaagaaaaattcaaattcttcgggaactgcacgtcttgcggatactttggttttaccttcaatagcaatactgactaccgcaggacgtaccttttctaacattggtgcaaggcttggtaatgcttgtccgtttacagcagtaggcaatgtagcgtgagccgccataggcgcagaaagcacacctaatccgagtactaaagaggttaaaagtgattttttcattgttgctttcattgattatccttactaaattcatgatttatattatttcttatttcaaacccagtgagttcgtattgcctttgactctgattttatttgtcagttctcagttttgtggttaattgtttaaaaatcattctttcagctaattttaatcaatatttgaccgatataattacaaaaatgtgaactacttcacattttatataaacaaagttttgtaggctaatttaccttaaggtaacaaattaatagaatacactgcctttttaggtttaacttatattcaactttttattcacaggatctccattatgttgtggttcttattttgcgtagccgtattaatcctaggctacttcgtttacggtaaaatcatcgaaaaaattttcgtgattaacccgaaaaaaacaacgccagcttacacaatgcaagacggtgttgactacgtaccaatgtctaaaaagcgtatttggctcattcagttattaaacattgcaggaacaggtccaatctttggtcctatccttggtgcgttatacggaccagttgcaatgctttggatcgtattaggttgtatcttcgcaggtgcagtacacgactacttctgtggtatgttaagtgtgcgtaacggcggtgcatcaatgcctaacttagctggtaaatacttaggtcgtccagttaaagcctttattaaccttttagccgttgtattacttcttctagtaggggtagtattcgtagcaagtcctgctcaattattaagtacaattactgttgacgtatttggttcagcaggtggcgcactctctttagataacgctgaagaaattgcgaaaacagcgacagtcgcaagcgacatcactgtatggggtatggataaaccaacggtaatcacagtatggacaaccatcattttctgttactacattcttgcaaccttacttccaattgacaaaatcatcggtcgtatctacccattcttcggtgcgttactcctatttatgtcagcaggtatggtgtatggtttagtgactagccacttcagtgcaacagaccctgttgatttcttccgtactattgatggaatgagtgctgagaagttcttccaaaacttccaagttaaaggcgatgttccagtttggccgttactcttcttaaccatctcttgtggtgcattatcaggtttccacgcaacacaaactccattaatggctcgttgtgcagaaaacgaaagcgaaggtcgcttcattttctacggtgcaatgattgctgaaggtgttattgcgttaatctggtgtatggttggtttagcattctatgaaaacccacaagctttacaagatgcaatcgcagcaggttcaccgtctaaagtggtatatgattcttctctttacttcttaggcttcgtgggcggtatctttgcagtattaggtgtggttgtattacctatcacatctggcgatactgcattccgtgcagcacgtttaatcattgcggagttcttcaatattgaacaaagaactttagtaaaacgcttaatgatttgtcttccattatttgctatcggttttatcgtttcaaaaatcgacttcagtatcttatggcgttacttcacttgggcaaaccaaacgacagcaatggtaatgttatggacagcagcggcttacttatatcgctacaataaattccactgggtatgtacaatccctgcggcatttattagtaccgtatcatttaccttcttagcgtacaataagattggtttcggtttagattaccaattatcggtatacattggtttagcattagcagcagcgtgcttagttgcattcttcacaatgattaaacgtgaaggtcaagaagacctggatgtttatattgatgatacaactaaagcataatcattgaattgttgaactataggggcgaattttcgccccttatttttgtggatgaacacagttgctacgaaaaaattaagtgtttgtgcaaatgatatataatactggataagtacagaaatcaaagctctttttttgaaatatgaatttggacgaatggcacatctagaaaacagacttatcaacagcttactgttaaatacgagttttctcaatgttttttaatccctgtaattcgacaccattcttctttttccatgatagaatcaagtttaaagctattttggtaagcttcacaaacggattctgcttgtgtagcaagaatacctgataaacctaaattcccctgtggttttactaacgtgataatttgaggggcaagttcttttaacgggcctgcaagaatatttgctataacgacatcagcaattaggttttgcggttgatcttttgtaagaaatagttgcaatctatccgctacaccatttacttccgcattgttctgactagctaaaattgcttgtggatcaatatcgatacctattgctttttttgcacctaatttaagagctgcaattgctaaaattcccgaaccacagccaaagtcaatgaccgttttatctgttaaatccagactgtctaaccaagctagacaaagtgcagttgttgggtgtgttcctgtgccaaatgctaaaccaggatctagcattacattgactgcatttggatcgggaatttctcgccaacttgggcagatccataaacgtttaccgaattgcattgggtggaaattgtccatccattcccgttcccaatctttatcttcaatttgttctattttatatggaaagtcagtagctacaagtttactttttactaatgtagaaacaatctctttcatgtcagtttctgcatcgaataaggcaacgacatcagtattaccccaaagacgagtttctccaggaagtggctcaaaaattggcgtatcttggctgtccataaaagtcacggacactgctccaatatcttctaaaaaatcgctaattttctcagcttctctatctgtactatttaaacgaatttgtacccaagccattttgttttccttcattttttaataaaatgattattatagccttgcatagcaggagcatacaagattaagtataagtcaatccaaatagaactaaataatgtatcttatttgaaaataacaagatcgaatattttggtctaaaaatgtatatttttaaaatttactccagtgatttattactaaatcaacgcatctctatacacatgaattacatatggatatcattgccaccatacgaaattgatacatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattataaccagctcttttgactttgtaagatgaaatgttatgtgatcagtatagtatttagaactaatacattgccataatattgattaatttagtgtagtatttgtagtactctcaccgttttcttccgcttgttgacgagctaaatagtccataaacaatgcatcaaagtttactggtgaaagatttaatgcagggaatgtaccacgatttactagacttgaaattaactctcgtgcataagggtaaagcacttcagggcatttcgctgcaagacagtgtgccaattggataccttcaatacctttgatggtaaatacacccgcttgttttacttcacagatgaatgcgacatcgttgctgtcttccaaagttgtttgaacattgatatgtaaaaccacttcgtaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttcacgcgtttctgtatcaagatcaaaacctaactgaggtttccattcttgatgaaaaatgtttggtaaattaggcgcttcaaaagaaacatctttgatatagatacgttgaatttgcatttcaaacggagtttgttgctcttcagtagcaacttgattttcttcagccatagtcattccttaattttaatgtattgaattatttatgttttttacaagcggtaagttagccgtacgccagccagcaatgccttcttttaatacatagactttatcgaagccctgtttcacaagttcattcgcaagcccactcgcacttaaaccattcgcatcaacaacaatcacaggacgatctttatatttttcgatagcctgtgtttttttacctttgatgtcgcttggaattaaatgcacgctctcaatgatatgaccgtgtctaaattcatcatcagaacgaacatcaactaacacagcatcttctttattgataagctgagttgcttgagcattatctacaattttgaatttgcttgttgcacctttatagaaattgatgattaccgcaataaaaagtgccacccacgctacaaccataatggtatgattagcggcgaactgttgaaattgttctgcaaaagtaagttgttccataggtttctctctaatgtaaatgaataatgatagcgaaagtaactcgccagcgacatttaatataaggcacgctaatgcgtgccaaattattaattagagaaattagccttgatgtgacattacttcatcaaatgaagatgctttttctgtcacttttgcttttgcaagcacagcttcaaccgcttgctcttctaatactacgttacgaatgttatcggttaaacgtggatttttcgcatagtattcaactacttctgctggttgctcgtaagccgatgctaattctgagatggtttctttcacacgagcttcatctacttttaactcattagatgtgatcacgctcgaaagtaatagacctacttgaacacgacgttttgcctctacttcaaacaattctgctggtaattgtgctgccatttctggcttgccaccgaaacgttgaactgcttgctgacgtaatacatcaacttcttccgctactgctgatgaaggaacttcaatgtcgttgtttgctaataagccgttgatcacttggttttttacacgagtagttaatgcattttttaactcacgttgcatatttttcttgatttcaacacgcaactcttcaacggtttttgctgaaccaaattttttcacgaactcttctgttaattcaggaagaacgatgttttctacttttttcaaggcgatagcaaattttgcagctttaccttttaagttctcagcgtggtattctgctgggaatatcacatcgatatcgaattgttcgccggctttgtgaccaacgataccctcttcaaaaccagggatcatacgaccttgacccattgctaatacgaagtcagaagccttaccgccttcaaactcttcgccatctactgaaccaacgaaatcgattgttacacggtcatctgcttttgctgcttcagtggtttctgcaaatgttgcttgttgtttgcgtaacacatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccattttgtctaaatcagcttctgtgatttcaaccactggtttttctacttcgatgttttctaaaccttttaattcaacttctgggaatacttcaaaagtcgctacgaatgagaaatcttgacctggttggtagttgtttggtgtgaatgttggacgacctgcaaggttgattttctctgcaatcactacatcaaagaaagcacgttgcatctcttcagataatacatcttgacgagccgctaaaccgtaacgttgttcaatgattgagtgaggaactttccctttacggaaaccatctacacgagcatttttcgcatagccttttaattgttctttgtaacctgcttcaattttatctgcagctacggtaactgttacacggcgttgtaagccttctaatgtttcaatagaaattgacattcttaaacctcagtattaaaaaggatttgattataaaatacaaatagatagcaattgtaacgtcctgtaaacacaatgtcgagaactttagtgattgaaataaaatatacgaatactcaataattaatatacttttattgtaggaataatttattcaatgtgaataaagcatatgcttaccaataagcatactgtacaaattctttataccgactatttctctaactaaagagaaataagcacaataaatgatatatctcccttagggttaatttactcacatcccaagaaaagtctattttcaatagctaaagatatttcaaaaatggagtttattgcgtttcatgtaagtacaaataaatattaaatctctacaataacaaattatttcatttatccattttattttctcccaaactatgttctaataccccccaacaacatttccgtaacatttgtattaaggtttaatcaatgttcagtggtctttttatcgggatacttctcggttttttcttacaacgtgggcaattttgcttcgtgtccggttttcgcaacatttatacccagcaaaactttcgcttttttaccgcattgttaattgcggtgtccattcaatccatcggatttttagtttaagtgaattagggctgatcaccattccgaataccccaatgcctctgttagcaacggtgttaggcggttttgtatttggtatcgggatgatcttggcaaattgctgtgccagcggtggttggtttcgcaccgaacttttaccaaacactggcacccttttgctaccgccgtgtgtatcggtctgctcggcgtgttggcgtggtttgtgagtgagcagtacggcagagcttacggctatggtgtcgctgtgccgaccgccaatgtggtgcaatatatcgtgatcgggcaacagcgttatctcaactggggaacttacttcgttctcggcattttgctcggctcttttattgccgcaaaattgagtggggaatttgaaatccgcgtgcctgaacccaaagcgattatgcaacgaatgttcggcggtatcctgatggggatcggtgccagccttgcaggcggttgtacgatcaccaactcactggtttcgaccgcttatttttcgtggcaaggttggcttgctacgctgatgattatgctcggctgttggactgcaacttactttattaagccaacgcaatgtcgtatttaatttaataaaccagcctaaattccctcccccgtttacgggggagggtgaggcccctgtgtataaccttgccaatccgcaacaaattgaacaaaacctgttacaacacgggatcaccaaagataaaactattgtgctttattccgacaatccgcttgccgcctatcgtgtgttttgggcgttgaaatgggctggtgtagaagatgtacgagtgttaaacggcaatcttgccacttggatagacgcaggttttccaacggaaaccaaagtcaatcagccactgcctaaaacggcgttcggcacaaccattccggctaatccgcagatcaacatcagcccaacctgagcaggcttacgcccgtctgcaacaaggcttgaagctcgttagcacaagggcgtgggaagagtttatcggcgaagtgagcggtgatgaacatattcaagcaacaggtgaaccgcagggagcaatttggggcttttcgggatcggcaccgtcaaatgtcgccgatttttacgaccctgatgacaccttgcgtaacccgaaagagatcgtggcactgtggcaaggacagcatattcaacagggcgatcaactggcgttctattgtggaacaggctggcgagcgtccgtgccgtggtttatgacccagcttctcggctggcaaaatacggcggtttatgacggcggttagaatgcgtggcagatggactcaaccttccctgtacagaaaggcgcgccgaataatatggcgaagccggatagtaaaaactaacatataaccctcgtaagcagtcagtttgttgcaataatttgtcataatctgaccgcttatatttttcgttctattgcttcgctatataaaaatcatattaaaataaaagaacttttcttcctagattacagtcttagcagcatatcttttatttttggagagcatgatgaaacgcactacacttacaaaccatcaatttttatgtgccagaagcctattttaacggcggttcaatcaatggatttacggctaacaccgcaccgattttcttacctaatgcggtcggaggctatatgcctgccaaagcagcaacctatgataaaaaaggtttcggctcgaatgcagataaaccgaatgcaatcgtaacagctctctctaaaggctatgtggtggcaagtgttggtgctcgtggtcgaacccttgagaaagacggcaaatatacaggaaaagcccctgcggcaatcattgacttaaaatcggcggttcgttacttgcattttaacgatcaacgaatggcaggtgatgcgaataaaattatctcaaatggaaccagtgcaggcggtgccttgtcggctctattaggggcaagtggcgatcatcgcgattatgcggaatacttcaaacaagttgaggcagcagaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgatgcgatttttgctgtatcagcttactgcccaattaccaacttagaaaatgccgatactgcttataaatgggaatttaatggcttaaatcaatttagtcgcattgatatgagccgtttatctgctgcaggttacaatgatcgctctcagccaaaacctcgcattgaaggtgaattaactgcagatcagatcaaaacttctcacgaactaaaagccgcatttcctgcttatgttaatagcctgaacttgaaagatgaaaaaggcaatttgcttacccttgataaagaaggaaacggctcttttaaagagtatgtcaaacaggtgatagtgagagcagctgatacggctcataaaaatggtacgaatttaagtgataagtcgtggctcactttgagtaaagatggtgtggctgatatggattggaacggttatattcattcagaaaaacgaatgaaatcaccgcctgcatttgatgcctttgatttaagctcaggggaaaataatctctttggaacggaaaccgttaataatcaacattttacctcttacgcccttgaacgcagtaccgcaaaaggcggtatggcagatgcacatatcatcaaaatgatgaacgcaatgaactacgttgaaaaccctaaagccgcagaacattggcgtattcgtgtaggcacttcagatcgcgatacttctcacgcaatcagtgcaattttagccattaagctcaatatggcaggtaaacaggtcgattatgaaaccccttggggcattccgcacgcaggggattatgatttagatgcactgtttaagtgggcggatagtattgcaaaatagcgtattttaaatagactaaaagttgctaaccattgtaaaagcaaaggctagcaactttttctcacacatattgatgttattacgtatttttcatcaatcgtgaaattctcccctcaaaaatttcctcatcacggattgtcataacctcgcagccatcttttgtaacaacaatttggtgttcatattgtgcagaatgactacgatctttagtttttaccgtccacccatctcccatcaggcgtatttcctttttcccagcattaatcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgatttaaacgaatacctggttttaccgcacgtaagccaatataaagacattcttgagtaacctctaacaagcgcttatctttaatcgttggctctcctacagcatacatttttgaattatccccataatagccatcctttatcacagtcacatcaatattcagaatatctcctttcttcaatttcttttctggatttggtatgccatggcacacaacttcattcaatgaaatacatgttgcttttggatagccatgatagcctaaacatgcgggaattgctttctgtacttgttcgatatattcatgacaaatgcgatctaattctccagtactaattccttctttaacatagggctcaatcatcactaaaacatcagaagctaacttacaggcaatacgtaacttttcaatctctgcctctgaacgaataggtatattcttcatttttacatctctctacaattaaataaaataaattatatcctctttagccaaataattcactccatataagtaagcattaccttaatgaatatctatatttgttactcaaccgtcactgacttcgccaagttacgaggctgatccacatcagttcccttaatcaaagcaacgtgataagaaagtaattgtaatggaacagcgtagaaaataggagctgtcacatggtctactttcgggaaagttaataccgtataaccttcttggctactaaaccctgcttcactatcagcaaagacatacatttgaccgccacgtgcacgcacttcttcaatatttgattttactttttcgagtaaatcattttctggtgcaaccacaatcacaggcatatccgcatcaattaatgctaacgggccgtgtttcaattcgcctgccgcataagcttccgcatgaatataagaaatctcttttaattttaatgcagattccattgcgataggatagaactcaccacgacctaagaagagcgtatgatgtttctctgcaaagtcttctgataatttttcaatctctttatcaaatactaatgcactttcaatttgtgctggtaagcgttgtaaagatttcacaatttccgtttcttgttcagcagagacattgccttttaaacgtcctaatgctgccgttaaaagtagtaaacaggttaattgtgttgtaaatgctttagttgaagcaacgccaacttctacaccagcacgggtcataaaagcaaagtcagattcacgcacaagggaagagcttgccacattacaaatcgtcattgccgccataaaaccagattctttggctaaacgtaatgccgctaaagtatctgcagtttcgcccgattgagaaatggtaattagcaaactatttggacgagtcacaaatttacggtaacgaaattcggaagcgatttcgacatcacaagccacgcctgcaatagattcaaaccagtaacgagccaccataccagcattgtaagacgtaccacaagcaacgatttgaatgtgttcaactttctttaagatctcttcagcattgttgctgattgcttcaatatttactttaccgttcgcaatacgtccttctaaagtattcataattgctactggctgttcaaaaatctctttttgcatatagtggcgatattgacctttatccgctgcatcagactcaaagttaccttcgtgaacgtcacgctctactttttcacctgcacgattatagatatcgacagtacgacgagtgatttctgctacatcaccttcttcaaggtagataaaacgacgagttacacttaataatgcaagcgggtcagaagcaaggaaattttccccaacacctaaaccgatcactaacgggctacctgaacgagcaactactaaatgctcaggttcatcttgattcattaccactgttccgtaagcaccacgaagctgtttgaccgcttttcttaccgcatcgagtaaatttggcgttgtacggaattcccattccactaaatgtgcaattacttcagtatccgtttgtgattggaatacataaccgcgttgttgtaattcagcactcagttcttcgtagttctcgataataccgttatgaacgacggcaattttgcctgaacggtgtgggtgagcattaacttctgatggctcaccgtgtgttgcccaacgggtatgtgcaatccctgtgccgcctaaaagtgggtttgcttcaagtgcttcatctaagaatttcactttacccacacggcgaacgatctgtaagttatgatcgtttcctaagactgcaacaccggctgagtcataaccacgatattctaaacggtgtaaaccatcgactaaaatttctgcgacatcacgttgtgctactgcacctacaattccacacataaatttgctttcctattttgttgcttatgttgtttattttgcaacaatcacctcaacccctaacgcctcaatttgttgtttgacgtttggatcaagctgatcatcagtaattaatttatcaatttgttgccattccaattcaagatttggcatttttcgtccgattttttgagattcaatcagcacaatcacttcccttgacacttcagccattacttggcttaagccaatgagttcattaaaagtggttgtgccacgggttaaatccagtccatcagcaccaataaaaagctgatcgaagtcgtaagaacgcaatacatttgcagcaactttcccctgaaacgactccgaacgagcgtcccaagttcctcctgtcatcaggactgtcggttcgcattctaaagcgattaattcatttgcaagcgcaagcgaatttgtcattacaactaagcctgaatgatgaagtgctttgactaacgttcctgttgtactcccgctatcaatgataatgcgattatgatctcgaatttgatttgctgccgcactagcaatagctaacttttgtttcgaaagttgctcttgcgattcttcattcatctctgttggtaattttattgcacctccgtagcgacgcaataaaaaaccgctttcttcaagagcggttagatccttacgaatagttacttcagaggtttcaaataagtgcgccaaatattccacacttacttcgccttgttcttgaacaagacctacaataatttgacggcgttgttgtgtatttcgttttgacacttaaattttccaaatatctttcgattcaaaatatgattattatatagaggaataattagcaagagaagtaaaacttgtagcatcattctggatgggagaacactgtaacatctataattaacaaatatcttgcatctataaaatgtaaaggaatagattgaaacctaaaataccaatacccacactaaatagaacatttcttaaccatacatagctcactactactcctactaatgctattatttgagcgataaataaggtataaccttcattacttttcggcaaacttaagctggtgagtaccagtaataccataatcacaagcggtaacattttgtttaatttttgcaaaattggcgaagatagtacagtttttggtaagaataacggcaaaaagcgacaaagttgagtgcctaatgccaatgcaatcaacatataaataatattttgtgtttccattaggcttgcccttttttctcagtgaatgattggggtaagaaagcgacaatgataatggcgatgatgattgccacaagcaagacgcttgtttgtgtgatttgccctgcaagtaaaaatccaatcaatgcaataaaaattggcttccactgcttttggctactgtattgttcataagctaaaatagcgaataagcaaggcagtgcaaaatctaaattgggaatatattgggaaacagaatcacccagtaaaatgccaacaatagttgcaaatgtccaataactcattcctaagatactgattttgaacatcatcgcctgacgagtttcttgtggtaaggtggttaatacgccaaagttttcatctgtcagatagcttaatgcaaaaaagcggttgagtttttctttgggtaatgatgaatgcatattaagtgtataaaaaataaaacgtaagctcatcaataaagtgctgagaaaaacggaaactactcccgctccagaaacaaaaaagggaattgctgcatactgtgctgtgcctgaaaaaacggtaaaacacatcacaaccgtaaaccacgctggcattccagcattggttgctaacattccataggcaatacctgcggcaaggtatcccataaatatcggtaaagtgagtttgaatgcactttcccaactattttccgtgttaaatgacatagagctccagcgtaaatttatgcaatgagtgcattttcaaaaaaatacaaacactctcttataacataaacctttataccaaatattaagccagaatataaagaggaccttttactccacaagatgttaacccgattattatcaggaagagcataaatatcagttttttcattatttatgtatgtattgttaattacgttgggtaaatgttacgttagaatagtataaaatgcaaaatcttttaagagagatgttgccgattgggtatttagcacaacaacagaataaaccttaccattacaataattgatatgcttgaataccacaacttctcccgccctcgcttgtctttcgcatactaccgaaacataccaacttaaactgctttttatcattgaaatacctattaccaactttttgctcttatattcaagattatttacgacactgatttaaaatatctaactctttctgataaacagagagcgataaatccatatccatcatacctatcacagaatgaaaataattgtcatgagaataggtttttgttttcgcattttctctaacgcaatttagatcaaaaggttcgtttttaatccactcttttgaaaaccacataatcatcgggactttggtttgatattcaggtgcaatagaataaagccaagggataagtttaattttgttcatagaaaggatttccgaaaatcaggcataaaaaagcggtcagcttctgcaaattttttacaaaaacagaccgctagtgaggataaattatttcttagtaatctgttttacatccacttgaactttgttccaatcgttatcaactttaccacgaatttgaatggtatcttgaggaccgatatttaaaccgttccaagcacgtttgcttacatcaatttcaatttcgcccgttgcgtctttaaagataaactcatctttgtcgatttgtttaacgatttgcccttcaagtagtgcaggggtgtcatccgccgctttaagtgcatctgctacgctcttcactgcaatactttcatcaaagaaaccctgtgattgatgtgttcttgctttgccatcgtgatagccaccgtgacgataatcatcatcaccttttgccattgatacagtagataccgctaataatgttgttaagataattgcttttttcatagaatactccgaatagttaaaataataattatgaataacgaaggctcttgcctttcgttgagagtattaaagcaagtaaatcttaaaaaattcttaagaagtaaaaaattttttatatctttattgataataaagatatctaatctctatttacattatgaattggaatcgactagagaaatgatatacaaaagtactagaagaatactactattgcctttttgaggcccaataaagggagaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaagttttagtattgaataaatagaataaaatcaagttacgcattactataaaccgtcttttcatcaagccaacggcgaattagctgtttagctgtatcgggatattttaacgttagctgtttagcgtagctctgcaccaacgggatcatcttacgatctcgcattaaatttgcaatcttgaactctgccattcccgtctgttttgtgcctagcacttcgcctggtcctcgaatttccaaatctttttcagcaatcacaaagccatcttggctatctctcagcacctgtaaacgcttagttgaaattttacccaatggggctttgtacatcaagacacaatgggaagccgtcgccccacgcccgacacgcccacgcagttggtgcaactgtgccagccccaagcgttcggaattttcgataatcatcaaactggcattcggcacatctacgccgacttcaatcactgttgttgcgactaacaaatcaatatctgccgccttaaattccgccataatcgcctgtttttcttgcggtttcattcgcccgtgaaccaagccaatccgcaaatctggcaaggctcgttgcaaatcttcggcaatcgccgctgccgcttgtgcttccaatacttccgactcatcaattagcgtacagacccaataggcttggcgtttttcatttttacaggcttgataaacacggcgaaccacttcatctcggcgatcttctgaaatcgccaccgtcgtaatcggcgttcgccctgggggaagttcgtcaataatggacgtatccaaatccgcatagacagtcatcgctaaggtgcgtggaataggcgttgcggtcataatcaactggtgcggatacacatcgcccttcgcccctttctcgcgtaaggttaaacgctgatgtacaccaaagcggtgctgttcatcaataatcacaagagcaagatgatgaaattccacctgatcttgaaacagggcgtgcgtgccgataatcatctgaacatcgccgtttttaatcgcttccaactgggctgttctcgctttacctttcactttgccagctaaccagcccacttcgatcccaaaaggtcgtagccagttggcaaaattatgggcgtgttgctcggcgagaatttcggtcggtgccattaacgccacctgtttaccattgtcaatcgccagcagtgccgccaatgctgccacaagggttttgcctgaacccacatcgccttgcaccagtcgcatcatcgggaaaggtttcgccaaatcctgttcaatctctgcggttacacgactttgggcgttagtcggttgaaacagcaaagtggctaaaaagcgttgttttaaatcggtttgataacatagcggttcagcaaagtgttgttgcacgcccattcgcacctgttgcattgccaaattatgtgccaacaactcttcaaaaatcagccgtttttgtgcagggtgttcgcctttatctaataattcggacgacacactcggtggcggtcgatgcaacaactgtaaggcttcttttaagctatatttgtgtggattaaattcatcgggaagcaattctgccacttgcacacgctcaagtaacgctaaggcttgatcggttaatttacgcaaagaggcttgcttcaagccttcggttgtcgggtaaatcggtgttaatgtttctgccagctcaagcggttgatttccccgaataatttgatattcagggtgatgaatttctgccataaagcgaccacgtttaatctcaccaaaggctttcactcttacgccagttgccagactatttttcattcccgcattgaaattaaagaatttcagggtaattttgcttgtgccgtcagaaattgtggtacttaaaatcggacgacgaccaaattgcacttccgtcagttgcacaaagccttcaaccgtcgcaaaattttcaggacgaacatccgcaatcggcgtgatccgagtacggtcttcataccgtagcggcaaatggaatagcagatcttgcacgttattaatgccgatccgactgagtttctctgaaatcgccgccccaacacccgaaagggcggttagcggtacaccgtctaatagttgttggttcattgcaaaatggttgtggaaaataaccgcttgattgtatgctacatagagagggctaaagtagcccttagggacaaaaaataaagatagtccctagtatgaatagagaaagaaattattctttatccatcaacactacccaaccactatctaaccaatcgcagagtgtatcgagtaagagttctaattcatcttgattttcggccttagaagcaagtttattccacgaaatcgcatcaccattggcaatacggattaacaaattagcctcggcctcattgagttcatcaatccactcaccattgacataaacgcgtaacgggttctcagtataaaggactttaacattcgcatcttgttgcacccaaccacccgcttctagcacctcctgtacttcatcaggataaaactcgttgtcttcggttaattgttcataacgacgcgtactaacggcagtagcaacactatgcgtaaagatttcatcaaactgcgtcgagttttgcaataagtcgatcaaacgtgcttttaacgtagcgaccatttttggatcgagtaaggcattaggttgcacatttggcgacaaacggaatgggattgcaaattgtgaatttggaatgatttccccttgatgctcaatggttctacatagattttcgagtaaatccgttgcatttggaaaacgtaaaccaaaagagaaggtcaagcaatcatcttgagctaagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatcttgagctaagccataatgtgaaaggcgtgacggcacataaagcacatcacctggtgcaagcacctcgtcaaaaatcaactcgcccatatcatcaaaaatacggatcggttggtttggtttaaattcagtgcttgggtcgcaccatttgcctaactgccaacgacgatgaccgtagccttgcacaaggaaaacatcatattcatcatagtgtctgccaacagaaccgccagcaggagcgtaagaaaccataatatcatcacgttgccattgtgggatatagccaaatgcttgccataatgcaccaagttctggcgaccactgttcaagattttgcactaatacagaccactgctcaggtaaattttcaaaatcttcagccgataacggactacgcttgagcgaccatttctcaccttctgctgtttgatgtgtttggatcaaacgagaagttacttcctcttcctgagctaattcaataatgtcttgaggctcaaacagccccacaatttgtggtaatccattacgaattaaaagcggtcgtttttgccagtaattttgcaaaaagtcttcagcagaaatattttcaggtaagcagaatgggatattcataggcagttccttatattgcaatctaaaatagcattttaacaacctatggcaagatttccaaacaactctatgcgattattcacaagttttagttccttggcattttgtagatatttcatctaacaactccctgatttttttccagatataattgctatccatttgtttaatctggttatagatagattgttctagaatgtattctgatgagtgtagagtatctcttatgatatattgctcataaatttcgggctgtaattcaaagtgaacaccagagagcaagaatttacctttaccataagatccacaaacaatggctgggcgatttgcagaatagcaagcaaccacagtctctgcatcctctgcttcactcaaaaacattggacctccatgataataaaagctcaattgagtgttattttgaaaagttaatgttgcaaaggtttttgatacagctgttccatcatagtagtactgattagtcaaatccggcaatgaaccaacagctttcccgttaaaaagcgctaattccctgttctcaaaaatttgataaccatctccagtaaattcgatggtctttgttgcataataagcaccggcacaaattccaagataaaaaccaccatgttgtacaaactgccgaatatgttggttcccttttccatttaattttgcacaataagggagatcagcgccgcctggcataatcaacatttgacaatgttctagctcattatcaataatgtgctgtgcagtaatagtttttgtgggtaaaccaagatttgtagcaattgcaagttgcaaagatgctacccctacatcactcaccccatcatctacataaatacaaactggttttaccatcttacttattgccctaaaacagttactttttagtgtaagtctagtataatctgcatccattttccaatttaaaggaagtaactatgtttataacacaactttctcagactaaaaaatggttagaggcaaaccaatctctttcttttattttgaaatctcttattggtgcaaatcttattgcgatttttgctcaaatttctgtgccaatgtatcccgttccaattacaggtcagacgctagcattaaccgtagttggttttgcattggggcgtaaagctgctgtttctgcagtattgctttatttatttgaaggtgtgattggtttaccagtatttgctaatggtggatctggatttcaaacgttattaggcccaacgggtggatatttaattggttttgtaccaacagcttatttattaggatactttagtgataaaggtattttaaaatctttctggaaaagtgttgtggtatcattagctgcgactgttattactttcgtttttggactagctcaactttcactttttgtaccaagcgataaagtgcttgaattcggtttatatccattcattattagcggagttattaaggctgtacttgctagcttgttggttattccgtcctataaattcttttcaaaattatgattgcttaactgctccgcaaggtcagcttaatatttctagttaagcacaatagacaaaagagttcgtgttaattgttttctttattaccacaaactctttttgtttacattcgttaaacactctcagcaagttaaatcacccctaacttttctaaagccaccaaaataccatcttgttcaatcggcaaagtgacataatctgccacagctttcagttcatcttccgcattgcccattgcaaccccaaagcctacggtagcaatcatttccaaatcatttaaaccatcaccaaacgccatcgcattttcaataccaaagccaaaatgattgagcacatcttgaataccgcgtgcttttgagttatttttatttaacaaatccaccgaatatttatgccaacgcacttcttttaaatcatcttctaaaattccagagcgaataacctcttccgtgcgttcttgtggaaaaaacaccaatagttgaataaccgagtgatccaaataaaaattcggatcgacaatataatcttctttaattggacgcaacgactcttcaacttccgccgtatttttagacaccgcaatttgttctgctgtcacaaaggcatactcaatctgcaacgcctgcagtttggctaatatacgctcaatacgttcagttgttagcggatattcactgataacctgatctcgataaaggttatattgtccgtttgtcgtcacaaacagatcaaaacctttttcattcattaacggcttgattgctttaggaaaagccccgtaagttctgcccgtggcaatcgcagggataatccctttagctcgtaaacgaggaagtacttgctctgaaatagacagcggaatacgggtttcttttttgtaatataaggtttcatcaatatcaaaaaacacaattttgattggggcagttggcttttgcataacatctccttttatgtttaatctgtgaaattttactcttttttcgatccgtgtcacaaaaattccccaaacttctcttaaaaaacttgatagagttcaaagaaaaaagttattgaggaaaagatgaacgactggggatttcgctgtgtacattgcgacagacggcttgccattgcatcacacggtatttgtagccgttgtaatgatctgctaaaacgccactgctactgtggtggctgtggaagttttctgttaagcgatcacaattactgtggaaattgtttaaagaacgaacctaaatggcatcgcatcgtgcaaatttcccaatataaaccaccgcttgcagaatggatccaccgcttcaaatttcaacagcaatattggcttgatcaaccgttagcacggctgctactacttgctatttatcaagctagacgaacacatcagctcacattacccgaagtgattttacccgtgccgttatattggcaacgtgaatggcaacgagactacaatcaagcggtgcttttagcccaacagttagcaaaatggcttcttctgccaatggataaagagagtttacaacgtattcgagccacccaaccgcaacgagagctaacaggccaagaacgtcgtaaaaatctacgaggggcttttatttatcaaccgaaacagccttatcaacgagtggcgattgtagatgatgtggtcacgactggctcaaccttaaatgccatctgtgctgaattactcaaacagggggtaaaggaaattcaggtgtggacgttagcgagagcctaaccaaaataacctttcacttgtctgccaaatagtttcggcaatctgctcaggcgtttcacgacgtaattcgcataatgcgttgaaactgacaactaaacgctctggacggttcggctcgccttgataaccaaagacaggcatatcaggggcatcggtttcaagtaacaaactttccaaaggcaatttacgcattgtttctctggttttatttgctctttgatagcttatcgtaccgcccaccccgattttataacctaaatcaacaaaacgcttcgcttgttcataacttcccgcaaacccgtgtacaacacctgttcgagcaagttgtgcttttttcaaaaaagtaaaaagctgatcgtggcttttgcgagagtgtaaattcacaggcaaatcataccgcttggcaaaagctaattgtgcttctaaaaatgcacattgtttatgccacagctcaggcgtacaaaccgcttcaactgctcgctctaagccaatctcggcaattgccgtgcaatgcggatcttggcgttgcagatagttttcaagtaaatccaaatcggctgtttgatgttcggcaatataaaggggatgtaagcctaagccatacacaatatggtttggttcagcttggctacaagcggacacttgctcaaaattttttgcagaaattgccacaactaaaattcgttccacctgttgagctttagcattatgcattaattgcgaaacagacagattgagatcttgagcaagatagtctagatgtgtgtgagtgtcgaaaaaacgcatattcaccttcgctcaatacttacttttactcgattttctatttatggacttggttctcgcattttttatcttaacttccttaaacaccggcttttccgctttcgcttttttcttcgccgttttgccttcaccacgagctttgcgtaagctggtcattaaaacaaaatcaatttttttatcgtcaagatttaccccgatcactttaaccctaacaggatcgcccaagcggtacattacgccgttttcgccgacaagacgctgacggtcgctgtcgaaatggtaatagccgttatctaaggttgaaatgtggactaaaccgtcgatcagcagttcgttgagttttacgaacaaaccaaaacccgttacgctggaaatcacaccgtcaaacacttcgccgatatgatcttgcatatattcacatttcagccaatcagccacttctcgtgtagcctcgtccgctcggcgttccgttgcagaacatttttcaccgaaaatatccatatcgtcgagctgatagtgatagccaccgccatcggtatagtgacgtttattgccttttyccttctcaatcaaatacttaatggcacgatgtaacaacaaatcaggataacggcggatcggtgaagtgaaatgggcatattccgtcaatgccaaaccaaaatgcccttcattatcaggagaatagaccgcttgtttgagtgagcgaagtaacattgtctgaattaattcggcatcaggacgttctttgacctgttctagcaattcggcgtaatctttaggcgttggacgcaaaccgccatttaagaataaaccacgctcttttaagaaagtacggaaactggtgagcttctcttcgctcggttgagcgtgaatacggaataaggctggttcatttgcttcttccacaaaacgagcggaagcaatgttggctaaaatcatacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcttcaatgattttatgtgcatcattgcggatcacaggctcaatccgttcaattcgcccttgcggattgaaaataaattgattttccactgtttcaaactcaattgcaccacgttggtgacgagtattcagcaacaccttatacattgcgtgcaactcttccaaatgtggcacaagataaaaataacgctcacgaagtgcttcgtcgccttctaaaatgttccacacttttgtataagttaagcgagcgtgcgagttcattaccgcttcatagaatttatagcccagtaacttaccgctttcagacaccgccatttctgccactaagcagagccgatctacttgcggatttaatgaacataacccatttgatagcacttcgggcaacatcgggatcacacgattagggaaatagaccgaattaccacgctgttgagcttcaagatcaagggcagtttttgggcgaacatagtaactcacatctgcaatcgccacccacaaacgccagccgttactctctttttgacaaaacaccgcatcatcaaaatctctcgcactttcgccatcaattgttactaacggcaaatcacgcagatcgacccgaccgattttggcttcttccggcacttcttcactaaattgacgcacctgtttttccacaccttcaggccaaatatgcggaatatcgtgattacgcagagcgatttcgatttccatacctggtgcaagattatcccctagaatttccgtaattacaccaacagggcgtttgaaatctgctttgcgtggctgaagttcaaccacaaccacttgccccattctcgcccctagacgatgttcttcagggatcaaaatatcctgattgatacgactatcatcaggcacaacataattaataccgctctcggtaaaaaaacgtccgacaatctgctttttacgcgcttcaagcacacgcacaatccgcacttctttacgcccacgacggtcaatcccattcggttgagccagtacaaaatcgccgtgcatcacacggatcatctgactattcggaataaaccaatcatcatcgccttcaacttgcaaaaagccgtagccatcacggtgtccaatcaccgtgcctttgattaagtccattttttcaggcaaggcataacgtttcttcttagtaaagactaactgcccatcattttccatcgcacgcaaacgacgacgcaccgcttcttgacgttcttcatcataaagatgaaacgcttcaagcaactcttctctgctcatcggagcgtcatagtcacgaatggtttgtaaaataaattccctgctcggcacagggttctcatatttctcgagttctttttggtaatttggatcaacgatcattctattattctctttataaaattatataacttattgtttttattattgaaatgtaaattcagaagtaggttcagttgggaaatgaatttagatcagataacttgatctggggggattttaacacagagaagaggttttgtacgaaaaagatctctgttcttctttttataataaaaacaaagggttaattctttataaaaataacaaaaatttgatctagttaaaacctaccacttccatcttcaaattcaactagatagaatttatcctgttttattattacttaacgaggtttgtatgctctattttgagtttttactattattagcgtttctctatgtaggtagccgttttggcggtatcggtctaggggttgtttcgggaattggtttagccgttgaagtatttattttacgtatgccaccaggtaaggcacctgtggacgtcatgttaattatcttagctgttgtaacctgtgcatctattttagaagcggctggcggtttaaaatatatgctccaaattgcagaacgtattctgcgtaaaaatccaaaacgtatcacacttttaggtccaattgttacctatatcatgacatttatgcttggaactggacactctgtatattcggtaatgccaattattgcagatattgcattaaaaaataaaatccgacctgagcgtccaatggctgcggcctctgttgcatcgcaattagctattacatcaagcccactttctgcagcagtagtattctatcttgcacggattacagaattaccagggcttgaaaatgtaaccttacttaatatcatctctgtaacagttccagctacttttgcaggtacaattgccttatcactatatagcttacgtcgtggtaaagagttggaagatgatccagaatatcaacgccgtttacaagatccaatctggcgtgaacgtattctaagtacaacaagtacaactttaaatgatgtattgccagctggtgctaaaaccgcagtattgttattcttactttcactaatcaccattgttgtaatcgcaatgttccctgaaattcgtactgtggcaacaggtgagaaagtgaaaccaatttcaatgtcacttatcattcaaatgatgatgctctgctttggtggtattattcttcttgcaacaagaactaacccacaaactgtgccaaatggtgtggtgtttaaatcaggtatggttgcagcgattgctatctttggtattgcgtggatgagtgatacttacttccaatatgcaatgccacaatttaaagcaggtattactgaaatggtagaaacctacccttggacttttgcattagctcttttcgcagtatctgtggtgatcaacagccaagcagcaactgccgtaatgatgttacctgttggtatcggcttaggtttgcctgctccattattagtcggtttaatgccagcaacttacgcttacttcttcattcctaactatccgtcagatattgcgacagtaaacttcgatgtaacaggtacaacgaagatcggtaaattctacttcaaccatagttttatggttccaggattaattggtgtacttgtcgcttgttgtgtaggcgtggcaattgcgaatgtagttatttaatcctacataatgtgagaagtcgtgcggaatatatgcattatatattccgcctatttttatcaaaaaacataaattcatcggttctcttttaatctatttttggccagaaaaatctacaagtatttgagaaataaattatttaatccataaaaatttcaagatcttgatcattttttcgggtatgataacgatcttctcaaccctattaatttggagcaaactgtgtcttccctttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgattgtttaactcacttacaagcaaaagtatcgccaactgattacagcacttggctacgtccgttgcaagcgagtgcaactagctctgaattagtgttgtacgcacataatcagtttgtagcaacttgggtgaaagataaatttttaggggagattgttacccttgctcgatctttaagcaaaaatgagcagttgcaagtggagatgcgagtagggatcaaaccagcagaacaagcggtgacttctgttacaccaactgcaacgccaccgcaagaaacgcaagctactgcattacgttctggacttactgaaacgctcacctttgataactttgttcaagggaagtctaaccaactcgctaaagccgttgctcaacaggttgcaagtaaccctggtgaaagccactgcaatccattttcgttatatggcggaacaggtcttggtaaaacgcacttgttgcacgcaatcggtaatgaaatcctaaaacaaaacccgaatgcgagagtggtttatattcactcagagcgttttgtgcaggatatggtcaaagcgattaaagcgaacaccattgagaatttcaaaaaattctatcgctctcttgatgtgttgatgattgacgatattcagttttttgcgaacaaagaggcaacacaagaggaatttttccatacctttaactcgttatttgaacgaagtaagcagattattgtgacttccgatgtatttccgaaaaacattgagaatatagaagaacgtatccgctctcgtttaagttggggggttaatgcggcgattgaaccgccagagttggaaactcgtgtggcaattttaatgaaaaaagcggaagaacgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaagatgtcgcctttttccttgggcaaaaactcagaacgaacgtgcgtgaattagaaggggcgttaaaccgtgcgattgcgtggagcaatttcaccagccgtcagatcacaattgatgcggtacgagaagccttaaaagatctgattgcctcttacgatcacttaattaccattgagaatattcagaaaaccgtcgctgagtattacaatatcaaaatggcggatttaaaatcaaaaagtcgtacacgttccgtagctcgcccacgccaaatggcaatggcattagcaaaagagctgactaaccacagtttgcctgaaatcggacgtgaatttggcggacgtgatcacacaacggtgatgcacgcctgcaaaaccattaatgagctaagagatactgataacagtatccaagaagattacaccaatttaacacgcaaattatcgtcttaaggaattgttatgcaatttactattacccgtgagcagttactcaagccgttacaacaggtttgtggcgtattaaccagtcgtccaacattacctgtaatcaacaacattttgctagaaattgaaggaagccgtttatctttaacgggaactgatttagaggtagagcttactacccaagcggagctgtttgaagcggtcagtttctcaggaaaatttactattcctgcgaaaaagtttttagatatttgtcgtagcttacctgatgatagcgtaatttcggtgcagtttgatgaagatcgtgtctttatccgtgcagatcgcagtaagttcaatctggcgaccttacctgcttcggattatccaagtttaatggactggaaacctgaagtcgatttcacaattgaacaagcgactttagcacgtttaattgaagcaactcaattttcaatggcaaaccaagatgcccgttacttcttaaatggtatgaagtttgaaactgaaggcaacttattgcgttcagtagcaacggacggacaccgccttgcagtctgcacaatggcattaaatcaagagcttttaacccattctgtgattgtgccacgcaaagcagtgttagagttagtccgcttggtagggcataataacgaaagcgttcgcttagaaatcggtacaagcaacctgcgtgtatcaatgaatggcattgtatttacatcaaaactgattgatggacgtttccctgattaccgccgagtgttgccacgcaatgcagatcgtattttagaggcagatgcagaggtgttaaaacgtgctttggtgcgtgcggcgattttgtcaaacgaacgtttccgtggcgtgcgtttagccttaaatcaaaatctgttaaaaattacggcaaataacccagagcaagaagaagcagaagagatcattgatgtctcttatcaaagtgcagagatggaagtgggctttaatgtgagctatctgttagatgtgcttaacacattaaaatgccagcgtgtgcgtattagccttgtagatgcaagttcaagctgtttaattgaagattgcgataatgctacggcggaatatgtgattatgccgatgagattgtaacttcagatgtagttatatttggagaaataaaatggaatacttagccccatttattcaaattgtggttggcttttttagctttatgttagtgttgcgaacttggctacagttctgtcgagttgatccttatatgccgatttcacaaacgttaatgcgtttaaccaaccctgtgttaaacccgctaagcaagctgatcccaacggtaaaaggaattaattttgctgcgttgcttttagctgcagggattgtggcattacaatttgtgttattcggtgttgatgtaccaagagctgtgcttatcggcttattaagtatcgtcaaaacctttgggcaaattctcttttttaccaccttaattcgagctttaatgagctgggtaacgcagggaaaccacccgttagattataccgttgctcaaattactgagcctgtacttggtattatccgtaaaattttaccgaaaacgggaatgttagacttctctgtaatggtgcttggttttgcgttgctctttattaatagcttgttctaccaagtctttggacaactatgggctgtggcgtaatgcaagcggtcgaattttgtgaaaatccgcaaggtatccgcttgcggatttttttacaaccgaaagcaagtcgagatcagattgtcggtttacacgataacgaactcaaaattgctattaccgctccccctattgatgggcaggcaaatgctcacttgctgaaatatctaagtaagttatttaaagtcccgaaaagcagtatcgtgttagaaaagggtgaactacaacgccataagcaaatttttgtgcctgaaccgaagctcattccaaaagagattgaagtattaggctgaacactgaaaaatttctatttttccatagcaaaacggcgataaaactgctaatttacacctattgaaaaccattcttaattgagagagaaattgaaatgttatttgcggtattgaccattgtggcttatttaggtgctttattatggattatgccaacacttgctcatcttgatacggataaacaaccgaatatccgtgcagtattgcttttgggcttagctgctgtactttgccatattattagcatttctcaacatctggttgtcaatggtggacaaaattttaccattgtaaatgttgcatctctgatcagtgtgattattagtgctgtggcgactttcgctttaactcgatggaaaacggtgtggtttccattgtctgtgatttatccgcttggtattgttactgtcaccttatctacctttgtcgcaggcagttttattaaacagctgtccgaaaatctagggttaatgctccatttaggcattgccattgcttcttatgcgttattttttatcgctctactttatgcggctcaacttaaatggttagataaaaatcttaaaagtaagaaaatggcattttctcccgtcgtacctccgttaatgaccgttgaacgtcacttttttaccttaacaatggtggctcaaggattgctcacagtcgcccttgtcacaggaatgatctacttacacaacttctttgcaccagagcatattcataaggcgattttttctttcattgcgtggattgtgtataacatcttattattggggcaatggaaactccgctggcgaggaaatcgggtgctaatttattcaatttcaggtatgatactgctttcggttgcctattttggcagtcgaatggtgtaataccactaaggtagcggttagatttgttctctgtgttgcaaatttttttattcatctaaccgcttgtgactaacgaacataggacttttattttggacacgatccccctgagtagtttattcatcacactagctattcttctattgctttctgcattcttctccggctctgaaacagggctaatgtcgttaaaccgctaccgtatgcgccaccttgctgataaagggcataaaggggcaaaacttgctgaaaaactgttatcgagaacagatgttttattaagtttaattttaatctgtaataaccttgtcaatattgccgcttccgcaattgcaacaatgattggtatgcaattatccggtgaagcaggtgtggcgattgcaacgggattacttacctttgtgatgttggttttctctgagattttacctaaaaccattgccgcactgtatcctgaaaaagttggctttactgtcagttatattcttatgccattacaaaaattattgatgccactagtgttctttatgaacctcatcattaatggcttgatgaaattattccgtatccgcaagtctgaaaaatcaggattaagtgcagaagaattacgaggggttgtacttgaagcagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccaacggctcaccaagagatgttagtgtcaattcttgatatggaaaaagttactgttgatgacattatggtgcctcgcaatgatattggcagtattgacattgacgatgattggaaatccattatgcgtcagctcacaggggcagcgcacgctcacgttgtgatttataaaagcgatatggataaaaacctactcggtatgttgcgtgttcgagaggcgtttcgcttaatgttagagcgtaatgaatttaccaaagagcaacttatccgtgcagtagatgagatctatttcattccagaaggaacgccattaaatacacaattgatgaatttcaaaaataacaaaaaacgtatcggtttagtagttgatgaatatggtgatattaaagggtgattacacttgaagatattttagaagaaatcgtgggggaatttactacttcaactgcaccatcattggaagaagaagtgaagccacaatcagatggctctgtactgatcgaaggctcagctaatttacgcgacttaaataaactctttgattggaatttgccattagatgaagccagaacctttaatggattaattttagagcatcttgaaaaaatccctgacgaagatacgcaatttaccttgcttaatttaaaggtcacggtacttgaagtatctgataatatggtgaagttggcgagggttgagccgatttcaaaataacacaactttcccttaaggttttatttggttaatattatgtgacaattaagttctacataatactaacaaacatagtatacaaaactattggtggatactggcttaaaacctcgtactataccgcttttaatatccaatagttatgcatttccaaacaataaagaaactcctttaaataaaactaatttaattcaagttggggatccgaatgatttttatcaaattagacaggtagagcttgcaactttaacaaaaataactacaatacgcgctcttttcaagacatcttatctaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacctaaaccaccaagacctccgcccatcatacctttcattccacgcatcatttttgccataccgcctttacgcatttttttcatcatacgttgcatttcgtcaaactgtttgagcagtttattcacatcttgcacttgcgttcctgaacctaacgcaatacggcgacggcgtgaacctttgataatatctgggttggcacgctctttcagggtcattgaattgatgatcgcttccattttgatgaacattttgtcatcgacttgatttttaacgtgatctggtaagtttttcgccccaggtaatttatcaagcattgacatcattccgcccatttttttcatttccactaactgttcacggaaatcatcaagggtaaaatcatcgcctttcttgaattttgccgccattttttcggctttttcctgatcgacagaacgttgtaaatcctcaatcaacgacagcacatcgcccatacctaaaatgcgtgaagcgatacgatcagggtggaacggctcaagggcatcggttttctcgccaacccctaagaatttaatcggcttgcctgtaatttgacgaatagataaagccgcaccgccacgagcatcaccatctactttggttaaaattacccccgtaagcggcaaggcttcgttaaaggcttttgccgtgtttgccgcatcttgacccgtcattgcatcgacagtaaacaaggtttcaatcgggtttaacaccgagtgaatttgctggatctcttccatcatctcgccatcaacgtgcaagcgacctgcggtatcgacaattaacacatcaaagaaattgagtttggcgtgtttcaatgctgcttcggcaatgtctaccggtttttgcgaggtttctgtcgggaagaaatcgacttttaacgcttcagccaacgtttgaagctgtttaatcgccgctggacgataaacgtcggcagacaccacaagcacttttttcttatggcgttcttttaagaatttcgccaatttaccaacagaggtcgttttaccagcgccctgcaaaccagccattaaaattaccgctggcggttgggtggcaaggttcagcccttcatttgcttcgcccatcgctttttcaagctcagtttgcacgattttcaggaactcttgccccggtgttaagctcttattaacttcttcgccaatggcacgctctttgactttattgataaactcacgcaccacaggcaaagccacatcggcttctaacaacgccatacgcacttcacgcagggtatctttaatgttatcttcggttaaacgccctttccccgtaatgtttttcagggttttagacagtctgtcggataggttctcaaacataatcttttctctatttgcaaaatttaggcttaatttgaccgcttatatcccctcttccgccttcggcaccttcccccgcttgtgggggaagggaagtcagggatgaaatgttggcattatacaaaaaaagaacgaaagagggggattagatcacagaaagttatacattcatcagaaaactcaaaatctttttaaagaacttcgatgttgaattttcgtttgtaccagttcccctctttgagcttcgaggggttaggggagatttggcagaatatacaacttctctttccttgatgtaaaactgctttattctttataacaattcttctagaataagtcgatttttttacaatatgagtatgctatgtcgaaatctatttgtatcatcaccggtagcaccttaggcggtgcggagtatgtcgccgatcatctcaatgatgttctcactgaacaaggctatcaggttgggctgtttaaccaagccgaattagccgatattcaacatcaaactgccctgttagtcgtcacatcaacacacggtgcaggagaactgccggaaaatatccagccccttttccaacaacttgccgaaagcaatcttgatctcagccagatgaaatttggggttgtcgggttaggcagttccgattacgacactttctgcaatgccgtcaatcttgttgagcaaggcttaactgccaaaggggcgacacaagtatgcgaatctctacgcattgacgtggtgaataattttgaccacgatggaagtgcggaagaatggcttccagcttttacttcaaccttataacaaggactaaactatgaaaaagctactaggcactctctttatgttatcagtgagcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaaaagctgaagctaggcataatattgcgataggttatggagcagattcaggaacacaagtaaactctcttgcgataggctaccgcgctacagtaagtgggactggagcaattgccttaggcaaacaagccaattcgacaaatagtcaaacaattgccatcgggagtgattcaaaagcgagcggagatgaatctattgccttaggcggacaagccaattcgacaaataatcaaacaattgccatcgggagtcagtcaaaagcgagcggagaacaatctattgtcttaggcacaggggccagtgtgacaggtactcaaacaattgtaataggtgcacgtgctagtgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagtcggacagtttacaacagcattggggagttatgcggaagcagaaacgcaagatggcgttgctctaggttatcgatccaagactagtcgtcagtcagggcgagcaggttggaaaccagataatacaaattattctattagcggaagtacattatctgctacgcatgcagcggtagcagtaggtgatggcctcaccgtcactcgtcaaattaccagtgttgctgcagggacagcagatactgacgcagcaaacgtggcgcaattaaaagcactgactttaaagatcagtggcgataaaaatacgcagggtcacacaacattttataacgaaacgctctcaattgtaggggctgatggtattagtacggcagttgagcagagaaatggcaattcaaaaattaccattactggctcaaaaacgtattttcatactaactataacgatgagtctcaaggtcagggagatcctacgactaatttcggcacaattactgacaaagctggagctacaggaacctatgcaataacagcgggggtaaatgcctctgcgactggaaattatggtattgcgatggggtataagagtaatgctagtgcttatgctgttgctcttggtagtgaatcgaaaggtgctggggcagattccattgcgataggtaattctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggttgtgggatggtacgcttaaagtgctaggcacaaatggcgaaatcaagaccaatgcgtctggctcaaccattacaatatcactagacgatacgattaaaaataaattagctgatgccagagcaggaagtttgatattcaagggcgaaaaaacagataacggtacaacaaatgatgttttgggtcaaaaatggaatgccaacaaagatgagaccgttaccattaaaagtgacgtaacataccaagacggtggtgttcgatacaaaggcgataacattgaaatttatcgtagaaatctagaattccatgtgttgatgaaagatgcaccaacattcagcagcgttcaatatggcgataatggacctaagattaccaacaccactgacggtaatctaaaagtaacaggtgcagacggcacttccccagttaagatcaccaatttaaaagcaggtacacaaaatggcgatgcggtgaactacatgcaattttcaaatgctggttggaaacttaaaattgctccgggaacggggggtcaagcagctccacctggggcacatcttatcaaaatggacgatacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggtccaaaaggagatgcaggagwaaaaggcgawargggtgmcmstggtgaagcaggaccaatgggccctcaaggtcctagaggtgagcraggtctaaraggtgaamsaggcccwgcgggtcctagaggcgaarctggttyaacaggtccgakgggtccarygggaccacaaggaccgcarggaacascgggtrctcmgggacmkaagggggataaaggcgatccaggacmwgcgggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaagtgttgataaaaagtgggctaatttgtctactatgccaaatttaaggggctgacctagattagctagcatactaatctaggtcagccccattatttaatatctatctcaattgatctctttattggtatcatcaaaatattgattcatttcaaaagcgggtttttgttgttgagaatgcccaataattcgagcagggacaccagctgcagtggcatattcaggcaccgcttgtaataccaccgaatttgccccaatttttgagtaacgaccaatctcaatattacctaaaattttagccccagccccaatcatcacgccttcacgaattttcgggtggcgatctccgtgttctttacctgtaccacctagcgttacaccttgcaaaatagacacatcgttttcgatcaccgccgtttctcccaccacaatccccgtggcgtggtctaacataatgccacaaccaacacgagccgcagggtgaatatccacatcaaaagcaacagaaatctcattttgcagataaatagccaacgcttttcgcccttgttgccacaaataatgggtaactctatagctttgcaaagcgtgatagcctttgagataaagcaaaggcgtactccatttatcgaccgcaggatctcgagtacgaacagcttcaatatcgcaggcagcactggcaataatttgcggatctgcttgataggcttcttctatgatccctttcaatgcaatcgctggcataatcgcatttgccagtttgtttgccaaaatatagcttaacgcatcgcctaaatgatgatgtttcagaatggttgcgtgaaaaaaactggcaagcatcggctcactatttgcaagctcttgtgcttcattacgaatattctgccaaataagatcaagcggttggtttgtcatctttattccccttttcgttcacgacctaaaagcgttttagcaacatcactggcgtgcttgccacagaacaacatctgataaatttgttccacaatcggcatctcaatgccttgtttttgagccagtaaataggcctctttggtattataaaacccctcaacgacctgcccaatttcagccatcgcctcttgagcatttctcccttgtccaagcattaaaccaaaacggcggttgcgagattgattgtcggtacaggttagcaccaaatcaccaagccctgccatacctataaaggtggtgggatttgcccctaaagacagccctagacgactaatctctgctaatccccgtgtaattaatgcagtgcgagcatttgccccaaagcccattccatctgaaatccctgtaccaatcgcaatcacatttttaatcgccccaccgagctgtacgccaaccatatcactattcaaataaacccgaaaggcttttgagcaatgaatacgctgttgcatttcatcggcaaactgaggatcagtggaagaaagagcaatagcagtcggcaatccttgagctaactcttttgcaaaagtcggcccagaaagcaccgctagcggatagcgatcacctaaaatttgcaaagccacttcttgcaacaatcttccagtgtctcgctctaacccttttgtcgcccacataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacataatacgatgttcagaagttaataacggttgaatttgttgtagaacttcagaaaaaacgtggctaggcacgacaattaaaatatcttttgagcgagttaatgccgttgcaagatcgctttcaatctctaatgcctctggaaatggaataccgggtagaaactcctcattcatacgccttacagccatttgagccattttttgcggattatgtccccaaaggtatgttttatgcccattacgagaaagtgcaatcgccaatgcagtgccgtatgaaccggcaccgagtacggtaatgggggctgaatatattttttccataaaaatatcttaattatttataatatacttattaactaatttatatatgataatctctaaaagcgatatattacagttatcaaataaatatttcacctaatgattcatggggataaaagaagtctttatgatttttaacgattttactcatttatggagtaaatttaataatgacgaagaatatcttaaggaaggtctaataatatgtaagactaactagccatgatgctaaaaatgtaataagactattcctattgaattatctctaagtttccataactattaaaatgtttatatattagacgtgtgaccgtatttttaatttttaatttttactaactaaaccaactccccacagaaccggtacccttcaccgtgaatagtcacgataatttctggggtatttgggtgatcttcaaagtgtttacggatacggcggatcgtcacatcaacggtacgatcgtgaggtttcaattcacgtcccttcatttgttttaacagatcttcacgggtctggattttccctggattttcacagaagtgaagtaaggctctaaactcactacgaggaagtttaattacctcattttcagggttaatcaaactgcgactatttacatctaaagtccagccattaaagcgataactttcggtattgtgtggatcttttaccgttttgtctttttccgccattgtgcgttgcaataagtttctggcacgaatagtgagttcacgaggattgaacggcttagtaatgtaatcatcagccccgatctctagccctaaaattttatccacttcgttatcacgtccagtcaaaaacattaatgcaatatcagtgttttctctgagttctcgagcaagcattaagccatttttgcctggtaaattgatatccataatcacaaggttaatttcgtgattatctaagatggtgttcatttcattgccgtcagtggcttcaaatacatcatagccttcagcttcaaatatgctttttaatgtacttctcgtaacagcttcatcttcaacaatgagaatttgtgggttttgcattagattaccttcagtttgtttgagttgccctgctactatgactgcgatagcgaacaaatgttgcaaagttgtagtattttatctctgttttttagcatcataaatacattattttacatttctttagcttcaatcaaaatctgctaagaaatattcgcgatgattttaacattattgttaaagtttgacatattcaagcggtaagttaagtaagttttttaccaaactctcggtcattgctcgatggctgagtaccgcatatttttcagcaagaataactcttgaaatcaccacaccttctaaaccttgcattcgacggaaatttaatgcactttgtaacggcaggaaacttggattgaatgccgcattttctgcatagcgtcccgtgataatctgttcaccacactgtaatgccagcccactcaccgctttactataaggcgcatacgcaagatttgccgccgaaattgccgcttgttgtaacgcatcgccacttgcttcaaagctattttgttgaggatcgaataaaaccttgtcaatctgtaaatcttttggcccaaaagcatctggcaggtaactgtgtaataaattattttgactatgtggtaaatgaatttttagttgtttggcactattgagttcattcataaattggcgacagtgtccgcaaggggtgtagttcactaccatatcggttaatgcagtttcccctgcgatccaagcgtgtgaaacggcactttgctctgcgtgaacagtttgttgcatcgcatcgctctcaaattcttgatttgccccaaaatagaaattccctgatttgccaatcgccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccattaaaccgcccatcgcatcaatttctttgactaaatgtcctttgccgatcccaccaatcgctgggttacaagacatttgtcctaaggtatctacattgtgtgttaaaagtaaggtttttaaacccatacgcgcaggggctagtgctgcttcagtaccagcgtgtcctccaccaactacgatcacatcgtatatttcacgataaatcatcttatttgccttgattaaattctgtttaaatgaaaatttgtctattctacctgaaaaaagcaagatctgaaaaaaggttttgatctaaagtgaatagggtcttgaagatgatcgccgatcttaataaaaatagatctatttatattaagatctttattattgtagttattagtcttacgaagaactgtgaataactaataaatatgtaataaattcaataagatctaaagataaaacgattgtgatgatcttgaaaaagggtaagatcttagttgtggataaagtggtaagttatccacagatgatattttttgataagttattcaagaatagatctcaagataaatacaggaaaaaagagagttatccacagatgaaatgaattacttttccctttttttgaacaatatctattctatttataatgtgacacaactcacagtttttaatggattagcttctcttttagaaaaaaatccctaaaatttgtgcagttcagttgtttatggataaactttatgcaacatcgtcagcaattaattttaacttacattgaaacctatcaagaagcgagcgtgcaggagcttgcaacacatctcaacgtttctttggaaactattcgccgtgatctgaataaaatggcaaaggaaggtctattgtatagaactcacggcggtgcggtaagccataaaaatcgtgatataggtcgttcttttgatgttcgtcgcagaatgaatagtaacgtgaaaaagtctattgcagaaaatgcattagagcatttttttgttggagctgtgataggtttagatgcgagttcaagtagctggaattttgcacaactcttacctgatctaccttgtacagttgtcacaagttctatgcacaatattagagcattggcaaataaaaccagcattgagatcattgcaacaggtggtgtgtattcagcgaaatatgatgcattttatggatctctttcggagcatctactttctcgtttaaatatagatattgccatttgttcttgcaccagtattgcagacggtattgtgtgggaatctaatgaaatgaatgcaatagctaaacgaaaaatgctagcagcgagtaagaaagtatttttattagcggatcattcaaagtttgaacgtaaagatcttattcagctttgtgatctttctacaattcaccatttatttacgaatcgttgccctcctgattctattcagatgctttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcaacatcaaattaatataactatttaaagtaaaataataatgtaatgatcaaattttgccctgcttctttattccgctaatcataaatctgggtttagaaacaaggcaattttgttttaagtctgctatttacttacttgagtcttgttgtaatcaggatgttttggtccaataagcaaaccaccgtttttccctaagtgaacaagatttgatgttgcaggtgctgctatttgataccctttatctttactggtatccattatttgactcacagctgctttaactagcatcactagcagaccatcattactatttgatgatccctgtgcgaaagaaccagccccttcccataaggtttttcctgttttgagatcaactagttttccttctaaggatacgttagttacgctatcaattaatttatagctcgtaccatattcctcaacattcacatagaagatcgcatctgcaccaaaaatttcacggattttgtttgtttttgctgagcggattgcatttccatcagttaaaccattctgtttgaatatttcatcaactaatgcgactggaaaaacatagtaacctagttcacctaaaggatagcttgttctagcaagaacactcgtatccgcctttgcatctacagagctatttgttggcatcactaccaaaattgattttggtttgctattttttaactcagtataatcataagaatccactttttgtttagcacagccagctaataatattaaacttgttaataaaacaaacaattttttcatagatgatccctattttttacgttgtaggtattgcataagcgttgtactttcaggatgtaattcctgctcttttttcatagctgtttgagcttcagcttgttttccctgttttaataaaacaagagctaaatgcccatatacaccgggtgcaacagttttttgatgtttagctgcttcagcaataatttgatttaaactttcttcttgcttaccaaaatcaccaggttcattataataatgatatataacatcagaataatttccccaatagtaaatatctttatttacattattagaagaacaagcagataaaatgatagagctaacaaggaaaatagtatattttatttttttcatattgattccttagtgagatggctgccaagagccagattcgataccatttacaaggttatttacagcttcacgaattgcaagatcaagaacttttccatttagtgttgcatcatagcttgcagttccaccaaaacctagcacttcacggtttgataaattatattcaccagcaccttgtgaggagtaaacaacttccgatgtttctacgttaacgacgtttaaggtaacttttgcataggctacttgttcttttcctctacctagaattccaaatagttgatgatcgcctacggttttacgtccaaattctgtaacatcgccagtaatcacataagttgcaccttttagattttgttttttacctttgatttttgcttcagaagcaatttcactcatatttgtgcgatcaacaactgaaaaacgaccagtttgttgtaagtgagaaattaaaatcgtttttgattgattacctaattgatctgccccatcagagaaaacaccattctggaaacttgatttattatcaaattttcccacggaaataactgattttacgcctttatattgacttgcagttattgctgcctgagttgatgttggtgtaattactcttgaaccttcagtagcacatccaactaatgttaatacagtaaagcataaaactcctactttcaaattactcataaaaaactcctgttaagatgaaaataaaacctatcaaatagatttatcaatatttgataccaatttcggtttaaaacgaaattagtacgcatattattatatttattttatgttgaaaagatgcccgattttcccctttctatcgccaaatcgggcaagtaaattgtaaaaaaattacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtaaattgtaaaaaaattactcaatcttaccgcttagggctggctttttgtgaggcaattcacaaaatctgcacaaatttcgtaaaaattcttttttcatcgtcaataagtagcaaaatatcctcgtcagtttaaccagttaattaaggggatttttatgactcaactcaaatcaactccagtaaaaattggtatccgcccaaccattgatggtcgccgtcttggggtgcgtgaatcattagaagatcaaacaatgaatatggcgaaagcggtggcgaagctcattagccaagaagttcgccatacaaatggggattttgtcgaatgtgtgattgccgatacttgtatcggtggtgtatttgaagcagctgcttgtgccgaaaaatttaaacgtgaaaatgtgggtgcagtgattactgtgacaccttgctggtgctatggctctgaaaccattgatatggatccgcatatgccaaaagcgatttggggctttaatggtactgaacgtccgggggcagtttatttagctgcttcgcttgctgggcacaaccaaatgggcttgccagcattctctatctacggcactgaagtgcaagaagcgagcgatcaatctatccctgatgatgtgcgtgaaaaattacttcgctttgctcgtgcaggcttagcggtggcgaccttacgcggtaaatcttatctctctatcggttctgtatcgatggggattgcaggctctatcgttaatcaagagttcttccaagactacttgggtatgcgtaacgaatatgttgatatgtctgaactcactcgccgtatggaacgtggtatttacgacaaagaagagtatgagttggcattgaaatgggcaaatgaattctgcattgaaggtgtggatgtcaatgcgcctgaaaaccaaatgagtgcggaagagaaagctaaattgcgtgaaaccttggtgaaaatgaccattatcacccgtgatttaatggtgggtaatccaaaacttgctaaactcaattttggtgaagaagccttaggtcataatgcgattgccgctggtttccaaggacaacgccattggacagaccacagcccgaacggcgactttatggaagccttactcaactctacttatgactggaacggcgtgcgtcctccatatattcttgcgaccgaaaacgactcgctcaatgcagttaatatgctgttcggcaacctcttaaccggtcaagctcaaatctttgccgatgtgcgtacttactggagccaagactccgtagaacgtgtaacaggctggcgaccagaaagtggctttatccacttaatcaactcaggttcagccgcgttagacggtacaggacaacataccgacaaggacggcaaacctgtgattaaaccgtactgggaagtgacagaagaagatggtaaacgttgcttagaaaatacccgttggtgcccagcggtttatgaatacttccgtggcggcggtttatcttcacaatatctcaccaaaggcggaatgccgtttacaatgcaccgcatcaatctcgtgaaaggtgtcggccctgtattacaaattgcggaaggttggtctatcgacttacctgaacacgtccacgatattctcaacaaacgaaccaacgaaacttggccaaccacttggtttgtaccacgcttgacaggacaaggtgcattcaccgatgtttactctgtaatggcaaactggggagctaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggagctaaccactgtgtagccacttacggacacgttggtgcggatttaattacccttgcttcaatgttgcgtattccagtcaatatgcacaacgtggcagataaagatgtgttccgcccaagtgcgtggagtatgttcggacaagataaagaaggtcaagattaccgtgcttgtgcgaattttggaccgctttatcgttaattaaaccttttctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctctatgccaatcgcatttatcttcgattgtggtgcaaccaatttacgcatagtggcaatggatcatcacggcaaattactggcggtacatcacattgcaaacaatacccaacaaggtgaagaagcaaccgactatcacatttgggatattgatgagatctggtcaaaactgatgacctgtgccaaacaaacccttgcacaacttacccctgaacaacggcaagatattgtcgggatttcggttacgacctttggggtggacggggcgatttttgacaaacacggcaaacaactctacccgattatttcgtggaaatgcccacgcactcagccgattatgcaagcgctcggcgattatctcgatgtggaaaaactctaccaacgaaacggcgtgggacattacagcttcaacacgttattcaaattactttggttgaaacaacataaacccgaactttacgcacaagcggagagtttcttgtttatttcttccattcttacttatcgtttaacgggtgtacaaagcaccgacagaacaatggctggtacatcaatgatgaccaacattgcaagcgactcgtgggatagcgaagtgctagatgtgttgggattaacagcaaaccattttccaccgatgaaaagtgcaggggaaaaaatcggcacattactgcctacacttgctgaagagcttggtttatcggcggatatttctgttctctcttgcggacacgatacccagtttgcgatcttcggctcaggggctggctacaaccaaccggtattaagttctggcacttgggaaatcttaatggctcgcacccaacaagccaaacccgaatggcaatatgtcaaagatggcttaaccattgaatttgacagccaagcaggctatttcaacccaggcgtgcaatgggtcagctcaggtattatggagtggctcggtaaacgcttctttagcgatgttgcaggtacagccgactattatccaacgatgattaacgaaggatcacaagttccagcaggttcgaatggcctaaaactggtcggtaattttgacggtaccagccaacaaactggctcaatcgaagggctttcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactggctcaatcgaagggctttcaatgcacacccaacgaggcgaaatttatcgtgcaggtttggaatatatggctcaccgcttgaaagccggacttgaggtattgcaacaagtcggacagttcaatgcagaaagtattatctgtgttggtggcggttcaaaaaatggcttatggaaccaaatccgtgctgatgtgcttaaccgcccaattgatgtcgtcgatatgtccgaaaccacagtgttaggtgcagcgatgttcactctcacaggtgcaggcgtattcgagaatatcgaacaagctcaacaggcaatgaaaccagcgcttaaacggatggagccgagtggagatgtgagggtttatcaatcataggagcgtaaattttccccaatatagctcccctctttagcaaagaggggctgggggagatttgacaggagtaattaacgaagaaaataatttatttggtaacgagtagtaaaatattaaggactttttaatctctcactttgcttattcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatatatgttaaaaggcattcaccctgcactttcccctgaattgctgaaagtgcttgcagagatgggacacggcgatgagatcgtcttatcagatgcccattttcctgcacatcaattacatcataaagtgatccgtgcagatggtattcaaattgccaccttacttgaagcgatcaccccattatttgaatatgaccaatatgtcgaacgtccactggcaatgatgcaagcggtacatggcgacagccttgatcttgcggttgaagaacgctatctcgccgcaatcgcaaaaattaacggaaaagcaccgcttgttgagcgtgttgaacgcttcgccttttacgaccgagcaaaaaccgcttatgccgtagtgattacaggcgaattagccaaatacggtaacatcatcttgaaaaaaggcgttaccccagttttaacagattaggaggagagtatgaatcgtcaaacattagcgagaaaaattattgacacctgtttggaaatgacccgtttggggttaaaccaaggcacggcaggaaacatcagtgtccgttatcaagacggtatgctgatcaccccatcaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttctttctgatgaagaaattaaagtcgttttaggcaaattctcaacttatggattgagagttgaagagaaacattaatttgatgttatgttagaagggcgagtagttaaattactcgcccttttactatgaagcttttcttaaggctaatgaaacagctatagtttgagctaatgtcattgtggcacattgtgaacggaagccgctaatttgagcttctttaataataaaagaaacatcactgaatgtaagcagtgggctaagttggctagggtgaaaaactgattgcaataacgacatcaccttctctaatcctatttagttgttcactaaacataccacctaaaccatcaattaaaaatacgtcgtaattcaaatggcttaaggcataatttagataacttgcgatactaaaagatcgttttaaaccaacaataaaaatacggtttgcattatctagaatttttgtaacggcttctaattgttcttcggtaatttgattggctagttgagcgagagcttgattatttccttgaataaataagcgaaggacatctgtatgatcgcctttggattcatttaatttaggttctatttgacgaaaaagttgaactcgctcagtataacttgttgttccttccatcaaattttgtcgatagagttgttttatatcgttaaatccacttaagccaaaagcattcgcaaaacggattagggtcgaaggcggtacttgtgctttttcagcaatttcagaaacggtgtcaaaaattacactatctccattgtctaaaatatattgtgcaacttgtttgagtcttttgcttaacgagtcatattgtttacgaacttcattttgaaaatgggttaactgggtttcttcattcatttcattcagattattattatcaaattaagcacaattatactgtattttgttgctttttaaatcaacacccctaatatttrtcatattaggggtgttatgtttatttagtatgcaaaattagcgttgcttccaataacgaatcagagtttgataacgtaacgcaactgcatcaattaactcttgatcattcagctgatttgctaaccatttttctgatgcttcaccaaaaatggtgcgacctacggcaaatcctttcacttttgagcaatctttagatgctttgaagaccgcttcaaatacttctgttggtgcatccagcccgagaattaagataccacggcaatctggatcgtatttatctattgtttcactcaatttagcccagccttctgcagaaatacctggtaatttccaccattctggttttatccccaattgatagaagtgttctaccatttcattatagtgattttcatcttgatccatggttgctggtagaataatttctaacaacaattcatgcccagtacggcaacaggcctgatacacttcttttaatttacgatcttggcgttgacgaagttcttgattgtcttgtggatggtaaaatgctaaacatttaatcacatgatctcgtgggaatgtaactaattggctacctaaatcaccgtgctcaagctctaatggacgagaacttggttcttcaattggacgagcaatccaataatttttccccgtaatttcatttaacgcatcttgaccaaatgtagtatcagcaagaatacctgcatttccatgggttaaaccttccgcttgtgcggtttgctccatagctttaagcaataactgttttaattttggaatacgattaacatcagcacctactttagccgccatatccactaattgtttacgatggtcaaaagcaaaaatacagagatcatcccactgttttttgcgtgtagtaacacgatgtaagtgatttaatttttcatctaaatcagggcgaggaacagattcagcacggctgagataatcatctaattctcgttttgtgggcattgcaggtgcacagccgtggcgagaaacaactaaagcaccacaagcattcgcataacgacaggcttgttcccatccttcgttatttgcataacctcttagtaaacctgacataaaggcatcaccagcaccaagaacattcaatacttctacccgtacaccatacacatttaatccgccatcaatatgatttggaatatcaccttcaaatacagaacaacctaacgcaccacgtttgcaaactaacactgcttgtgtaaattgacgtacatttttcaatgcggttaaggtatcagttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaagtacttcttgaagagatttagtcacttcctgtgaatcaatatagcgagtttcgccatcacctaaagaggttaatccccataatactggacggtaatcaatatctaatgcacgttttacgtcattacgacctgcatattctaaggctgttaaaactgtttctcgtgttttagggtgagaaagatgtgtgccagtaatcgccaaaatacgtgacgaagcaatgtagctttcactgaaatcatccttactgatcgccatatcggcacaattttcacgatagaaaattaaagggaaggtttctttatctttaataccgagaatcactaatcctgttaaacgctctttatcggtaattaaatggctagtatctacgcctannnnnnnnnnntcttcacgaagaaaacgccccatatgctcatcgccaacacgcgctaacatagatgaacgtagtccttgaatagctgttccatacgctacattccctgatgagccacccaaatattttgcgaaactcatttcctcttcaagccgagaaccaatttgttgaccgtataaatctaccgcaactcgcccaagacagatgacatcaagagggcgatcttgatgattaacgtatgccataacaatgcctccataaaataattgaaaagatcttaattttcaatcattatacaaaaatgaaatgaatatttcaaattaaacttgattttttatttatttttgtgaccaatgtcaaatctttaaccaataaggaataaagtttaaaaagtgcgagatagatcacatcattaactaaaatgctttgatattataaaatgaaataaatttttcataatatgagaaactactttaattttatctctaacctaggagggagtatgcagactatcaaactcacagtggcacaggcacttgtgaaattccttgataatcaatatattgaaattgatggcaaagaaattaaatttgttcacggtattgccgctatttttggtcannnnnnnnnnnnnnnnnnnnnnnnnnnnnnnnnnnnnnnnnnnnnnnnnnnnnnnnnntatcaaggacgaaatgaacaaggtatggcacaccttgcaattggttttgccaaacaacataaacgtcaacaaatcattgcttgtacatcctctgtcggccctggtgctgccaatatggtcacagctgcggctactgccacatctaaccgaattcctctattattactaccaggagatgtatttgcaactcgccaacctgatcccgtgttacaacaaattgaacaaccgcatgatttaagtattagcactaatgatgcttttcgttcagtgagcaagtattgggatagagtgcaacgacctgagcagttaatgagtgcttgtatcaatgcaatgcgagtgttaactgatcctgctgaaacaggcgctgtaaccatcgcattaccgcaagatgtccaagcagaagcttatgacttcccagtaagcttcttacaaaaacgagtacatcgcattgaacgtacaccaccaacccaagagatgctggctgatgctgtcaaattaatcacctctaagaaaaaaccgcttatcgtttgcggtggtggtgttcgttattctgaagcgtgtcgttcattacaacattttgcagaaaaatttggtattccatttgcagaaacacaagcaggtaaaagtgcaattgtttcaagccatgaattaaacgtaggtggtgtcggtgaaactggctgcctagccgctaaccgcttagccaaagaggcagatttaattatagggattggtacacgttataccgattttacgacatcttcaaaatggattttccaaaatccagaagtttctttcttaaatgttaacattgctcgcttcgacgcatataaattagatggcgtacaaatggtatcggatgctaaacaaactattaatgcactcattgataagctaccgctgggttacaaaacacaatggggagataccattaaacaagcaaaagcggactttgccgatgaattacaacgcttacgacaagtaaaatttgctgacggatttgttccagaaattaatgataatctcgatcatgacactgtttatgccgaatttatcaaactcaccaactcttgcctaacccaaagccaagttttaggtattgtaaatgaaacgattgataatagtgcagttatcgtaggtgcagcaggtagtttaccaggtgatttacaacgtacttggttaagtaagagtgaagacagctaccatcttgaatacggttattcttgcatgggttatgaagtcaatgcggctgttggtgtgaaaattgcacaaccagaacgtgaagtttatgcgttagtgggcgatggtgcgtttttaatgtcccactcagaacttgtcacttcaattcaggaaggtaaaaaaatcaatgtcgtattgtttgacaatatggcaaatggttgtatcaacaatttacaaattggtaatggtatgggtagctacggtacagaattccgtttccgtaaccctgaaacaaaccaacttaatggcagcttaattccagtggactttgcaatgtgtgctgcagcttatgggtgcaaaacctacaaagttacaaccgaagatgaactacgcaaagccttagctgatgcaaaacaacaaaccgtatctacgttaattgatattaaagtattaccaaaaacaatggctcatggctatggttgttggtggcacgttggtgttgctgatgtttcaacgagtgaacgtattcagcaagcacatcaacgttctaaagaacagttagcaaaagcaagaaaatattaattacaagcggtacgatttgtaaaattttttgcaaatcataccgcttacactctttctatttatttctcaatgaggatttcactatgaaagctgaaaacattcaattaggtattgcccctattggttggacaaacgatgatttaccggaacttggtgcggaaaacacatttgaacaatgtgtgagtgaaatggcacttgcaggctacacaggctgcgaagtaggtaacaaatatccacgtgatgttgctgtccttaaacataaattagatgtccgtggtattcaaatttgtaatgcatggttcagcacattctttgttgatggcaaacgagaagaaaccattcaagaatttatcaaacaccgtgattttctacacgcaatgggggcaaaagtaattggttgttcagagcaaagccgtagtattcaaggtacaacaaaagcagtatttaaagaaaaacccattttcaatgatgaagactggcaacgtttagctgagggttataatgaattagccaaactcgctgctgaaaaaggaatgaaagtcagcctacatcaccatatgggaacaggcattcaaaccccagaggaagttgatcgctatatgtctgtagtcaatgacgatgtttacttattatttgattctggtcacctttactattcagaaggctgccaaaaagcgatgttagctgtacttgaaaaatatattcaccgtatcgtacacgttcacttaaaagacgtacgtgatgaagtggttgctgaagttaaagccaaagatttaagtttcttagaaggtgtgaaaaaaggtacatttaccgttccaggggatggtgtaatcgatttcaaaccaattttcgatattcttgaaaaatacgactacaaaggttggatggttgtagaagcagaacaggatccagcattagctaacccatttgagtatgctttaaaaggtcgcaaatatattcgtgaagttgcaggagtttaatatgttaaaagttggtattattggtgcaggccgtatcggtcgtgtacattcagaaagtatctcaaaatatgtaaaaggtgctgaaattaaagcgatttcagatattaaagtcactaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaattaaccgcttgggcaaaatcaatgggcattccaaatgtctatgatgattacaaaaaaatcctacaagatcctgaaattgatgcggtattagtttgttcatcaaccaatacccatgcaccaatttcaatcgaagctgcacaagcaggtaaacatattttctgtgaaaaaccaattgatgcagatgtgggacgtattcacgaagtattaagtgctgttgaaaaagcaggtgtaaaattccaagtaggttttaaccgtcgttttgaccataacttcaaagcaattaaaaaccgtgttgcgaacggtgatattggtgaaccacatctcattcgtgtcacttctcgtgacccagatgcaccaccaattgaatatgtaaaagtatcaggtggaatgttctttgatatgactattcacgattttgatatggtgcgttacttatcaggtagtgaagtgattgaagtgtttgcggctggcggtgtattagttaatccagaaattggtaaagctggtgatattgatactgcagtgatcaccttaaaactagcaaatggtgcaattgcagtcattgataacagccgtaaagcggtatatggttacgaccaacgtgcagaagtctttggttctaaaggtgcggtacaaactcgtaacgatacggattcaaccgctgtatattcttgtgaagctggcgttatcgcagaaaaaccaaaatatttcttcttagagcgttatatgcaatctttcgcagatgaaatggcatgcttcattgattctgtggtaaacaataaaccaacactcgtcaacggtaacgatggtttacaacctgtcttaattgcgttggcagcgaaaaaatctcttgaagaaaatcgtccagttaaattaagcgaagtcgcttaattctcccgatacaagcggtacgatttggtaagttttttgcaaaatcgtaccgctttcatttttattgattaaggtaaatttagagtatcaaatcagtatttgagacataaaaaaaacctagccacttggctaggttttgttgtttatagattagattatttagcttcagatcttgctttttctgccattaatcgttcttgttctaatgactcagcatcttggttttgttctttcgctatacagattttttcatacattttgaagaatggatagtaaatgaaaatatcgagtatgattaaactcaagctcaagataggagcccaaacatcaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngataccaaataagctccgataggtgctggggttgtccaaggtgccattaagtagatacgatggataagatcaaagtctaagatgagataagcgatgatcgcatttgccattggtgcaaagattaatgggataaagaagagtgggttaaccaccattggaacgccatatacaatcggttcaccaattgagaagatagacggaaccaaaccgattttaccaattgagcgtaaatgtgcagagcggctgcgtacgagtaggattgctaatgcaataacaccaccagatgcaccatgtacaatgtagaagtcccaaaatgagttagtaataatgaatggaagtggttctcctgcctgtaatgccgctaagtttgccgccatattttgtaataggaatggtgtccaaagttgcattaatacaagtgatccgttaatacctaggaaccataataagtgcgttgcaaatacgaataaacagattgcaccaagagagtcactcactttaattaatggagccataaagtccataattaattgtggaatatttgttcctgtggcgtgttctacataaagggcaaatgggtagagtgtcactaatacagctaaaattgggataacaatattgagagattcggcaactgctgttggaacttcttttggtaagcggatgcgaatatgcaaatactcaagtaagcgtgttaattctacggtataaattgcaatgaaaatagaggagaaaagtccaataccaccaaaaaatttaatgtccatcataccatctttaactggtgcagcgaccaataagaaagccatgaccgacaagaaagctgcaggcagtggctcacgtttataagctttagccaagttgtatgcaatacttcctgcggtaaataatgaaatagcattaaatgacatttggaagaaacgccagccatagtcgcttgcccaacgagcaaactcccaccacgctttaccaaatgcattttgcgtattctcatcaaaaggtggaataagcaaaatcataataaaactaccgacaatcaaaaatggtaatacaacaataaaaccatcacgaattgcagaaatatgtggttgattttccatccgttttgcaactggtgcaacgtggttgttcataaaatcaataaaacgtcctgatgtggttgacatactatgcttctccatttgcaattttgaaacctaacatataccaatcttcttgatagttttcgatatgtaatgttctgcctttttcgttgtgctcaacgttaaacttaacagctttatttagtgattcaagctcaccaaacactgaaagcggtaagttattttgtccgttttgtaatccatcaataaagagatagagatcagtgcctacttttgtgtaataggtagtgagattaccaattttttgcgttgggaatttgctgcatcttgaatggtagataccttcaccgttgatatttagccattgtcccagagcaagcaaacgctccacttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcttcaggaattgttccatccgcttttggaccaatattgagcaataagttaccgttatcagcgacagtttctactaaaagagacacgagatctttaacagaaatcaggtgactttcatcttcaatttggttgtagccaaatgaaagccccataccacgacacatttcccattttttatcacgagaggctgttccgtgtttatactctttagacgtaaagtcgcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaagtttattccaacgatcatcaacaacgccatctgcaacagaattgtagtagtgagcaaaaaggtgtggaagcatatgttcccctacttttggccaaccaatatcgttccatagaacatctggtttatagcggtcaatcaattcaatgacttgtttataagcaaagtcggcatattcgtaggttgggcaggcattagagaaattttggctttctgtaaaaataggtgctgaagaatattgccagtcgataataccagagtagtatgctcccatacgtaatcctttttctcgaacttgttcagtgagttcacccattaaatcacgttgagggcctgctttggtgcagttgaaatcggtatatttacttggatataaacagaagccatcgtggtgttttgtcgttaacacgacgtatttagccccagcttgagcaaagagttctgcccatttttcaggttgccatttttctgctttccattgcggaataaattggtcgtaagtgaaatctttgccataggttttaatgtgatgttcgtaagttggtcctttctgaacgttaatggaattaaaataccattctgcgtacggattattacagaaccactgctcatcaatatcaatttcacctaattggcaagttggtggagcgaatgcaggaacagaataaactccccagtggataaaaataccaaatttagcatcttcataccattgaggtacctcatgggttttgattgactgccagtctgcgtggtaacgtttttgtttagtgtcagtcatagtaggctcctatttttagcatacataaaaataaggtccgcatatattgtgatatgcagacccttccgatttcatattaaatttctttcacatctacccagcgtttttcttcagcggatttagcgatggcttcgagaactctggatactctatatccttcttcaaaatctggccacattctgtcatctgcggcgataccattgactaaatcacggatttctacgcttttttgatcattaaaaccaataccgtgtcctgcacttacgcagaatgcggcgtagtcaggatgttctggtccaacgagaatagttttaaatccttgacgagatttatcttcatcatgtaaataaagtttaagttcagccattctctcttgggtgtaggtcaatgtgccttttgttcctgttaccacgtaggtcaagcccattttacgaccgcaagcgatacgagagctttcaatcgttcccatcacaccattggcaaaacgcaccatagcggttgcttggtcttcgttttctactttcactttttctgaaaggttatttggatttgggcgttctgtgataacggtttgcatatcgcccacaaccgaggtaatttcttcaccgactaaataatgagccatattaacaatgtgagttgcgagatcgcctaacgtacctaatcctgctttacttcgatagcagtgccagtcaatcggtgtatttgggctagcaagatagtcttcattatgtgtgccataaaaatgaacgacatcaccaatttccccgtttttgataatttcacgagcaagctgtgaggttgggttcttcatgtagttaaacccaactagtgtttttacacctgctttttgggcggcttcaaccatctcttttgcatctgctgcagttaatgcgagcggtttttctgaataaacatgtttgccattagcaatggcagccaaagcgatttctttatgtaagaaatttggggtacaaatatctacaacatcaacattcggatctgcaaccagttctctccaatctcctgttgctcgagcaaagccaaattctttcgcttttttctctgcaagttcttgattaatttcagcaagatactcaaggtgtagttcacctttcagtgggaatagtgttggtgcttgtgcataagcaatcgcgtgacagcgaccgatatagcctgtacctactaaaccaattctcacttttttcatacaaagctccttaagttgtaagcggtatgatatacagaaaatgttgcaaacttttagagatatcttgccgcttgtaatctatatatttatgcgactatgcggcttttctgcggcgttttaatgtatcgagcaatacggcaatcacgataattccacctttcacaatttgttgccaataagggtcaacgcctaacatatttaatcctttattggttgtgccgataattaaagctccgataacacacattggaatggttccaaagccaccgcttaacgaaacaccaccaattactgccgcagcgatagcatcaagttcccacgctaagccataagatgggttacctgcataggtacgagctgcaagtaatgcaccagcaagaccagataaagcccccgcaaaggtataaacaagaattaatgtttttgttgtattgattccacagatttttgctgcgttgagattaccacccacagcataaacgtgacgaccaaaggttgaacggcttagtaaaatatgtgagccaataacaatgagaatatagagaataactaatccaggtaagctcagaatgtttacatcggcaatccaagtaaaggcttcagatgaagcatcgatagggcgtccagcagaataaagctgtgcagcaccacgtgcaataatcatcatacctaaggttgcaatgaaaggcggaataccaccgagagcagttaacccaccatttattgcacctaaaaaagcacctagagcaagagacattgcaaaggctaaaatggcagaactagctaaatctccccctgttaccattgaggctgcaactacggaggttagtgcgacaacagatccagaggataagtcgatccctgtggtgataatggcaaacgttaccccaatagcaataataccgaacattgatacttgctcaataatactccacacggtacgggcagagaaaaagccttcgatagaaacggataataggagaaataaaataattaaaattaacaccattccatatgtattaattattttctttaatgttgcttgtgacatagtacatacctcgctatttatacataatatggtttgagtctttactgttttactaatccagatgcaaatgctaggactcgttcctgagagagttcttgatgtggaataatgccaaccttatggccttcgtgcataaccattacgcgatcgctcatcgataatagctctaacatatccgaagtaatcataatgatggttttaccttgttttgagagttctaccattaacttataaagttctgccttagctccaacatcaatacctttggttggttcatctagaattaaaatttcaggttcgagaagtaaccaacgggcgagtaacactttttgttgatttcctccagataagttatttgtaataacctctacatcaggtgccttaattttgagtttctttttctgctcattggcagtttgttgtgatttatcggtagaaattaagaaatgttctaaataaggcgacatttgtggcatgatcatattgtccacaatgtttaaattgaggaataaacccgttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggaataaacccgttaatttacgatcttcggtaacaaagccaattttatgtgccatggcatcaagaggatttttgatttcaacttgtttgccatgaatataaatttctccactatctgcaggtttataaccaaataaactttcaacaatttcagagcgaccagctcccactaagccagcaattccaaaaatttctcccttacgcacagaaaaactgacatcttgatattttcctgctcgcgtaaaattcttaacttcaagaacaatttcattagataattcaaaacgttctctttggaacatttctgacatatctcgtccaaccatcattgaaattaattcttctttagttacatcagtagtggcttttgtacccacatattgtccatctcgaataacggtaatttcatcagatattttgaaaacttcattaagtttatgagagataaagataatggcgataccacgttttttaaccgcatcaatgattttatatagttgttctacttccatttcggttaaagcggttgttggttcgtccataatgatgattttggcatcattagaaaccgcagtagcaatagcaactaattgagcttttgcaactgaaacttcagacattttgacggtaacatccattggaataccaagnnnnnnnnnnnnnnnnnnnnntttgcgatccatttctgcctgatctaagaagaattttcctttagtcatttctcgccccaaatagaaattatctgcaatagtnnnnnnnnnnnnnnnnnnnatttcttgaggtaccattgtgagcccactacgaatagcatcaatagggcgggawggtttaaacggtttatcatcnnnnnnnnnnnnnnnnnnnnnnnnnnnnnnnnnnnnnccatacaggattttcatcaaagtggattttccagctccattttctcccattaaagcatgaatggttccacgtttgacttttaaattaatgccatctaatgcttttacccctgggaatgttttagagacatttcgcatttctaaaatataaggggagctatgtgtattcattgttaactccttgatttttaaggannnnnnnnnnnnnnnnnnnnnnnnnnnnnnnnnnnnnnnnnnnnnnnnnnnnnnnnnnnnnnnnnnnnnnnnnnnnnnnnnnnnnnattacttatattttgctctatatttatctttgagatctggagtaactaattcaaaaggaacccagttgtatttttcaacagcttctccttttgcgattttataagcgatttctgctccagcgtatccttgtccttgagctgattggaatactgttgcgtctaagccactgcctaagtattcaagagcatctggtgttgcatcaacacctacaataatgatgtcttcatctttaatacctaacttgcggcttgcaagtactgcaccaattgccatctcatcattgttacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattgccatctcatcattgttacttgcaataacattgatttttttgttagcggcaagtacgttttctgtaatggtgagacctctgtctctttcccatttaccttcttgttcagaaactactttaacgttacctgttctagcaaagatttctttcacaccctctgaccgtttagctgttgcatctaaaccaagaatacccattaagattaaagattctgcagatttaccatttaaagcatttacaatgtaatcaccttgaatacgtccagcttcaatttcatcagaaccaacatagctagtaacatattgcatatcttcatcgtttggtttacggttaacaacaattaacgggatattcgctttcttcgctaatctcccaattctcttcacaatttgtggatctgttggaacaactaataatgcatcaactttttgatcgataaagttttcaacatcatttaattgacgtgcagggtcaccgtttgcatcagtgagtttaatttcaacgtcattatgttttgcatcaaaatctcttacagactcttgtaaataggtttgccatttatctgcaaatgcagccattggtgcaccaataacaatatttttggcagatgctgtttgagaaagtaataaaccactgcataaaacagctaataatgcttttttcataagccactccttnnnnnnnnnnnnnnnnnnnnnnnnnnnnnnnnnnnnnnnnnnnnnnnnnnnnnnnnnnnnnattgtgaatataaatttcaaaatnnnnnnnnnnnnnnnnnnnnnnnnnnnnnnnnnnnnnnnnnnnnnnnnnnnnnnnnngcaacgactagattttaattttgtgaattagatcgtgtttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttggcatactaaaggcagcttgtgatctcacactattatctggccaacgtgttgtaatggttttcatacgagtatagaaacgaacgccatcgctaccatacacatttaatggaccaaagatagaagctttccaaccaccgaaacagtggaatgccatcggtactggaattggaatatttacgccaaccatacccgcttgtacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaccatacccgcttgtacatcttgggtaaattgacgagctgcatctccatcacttgtaaagatagcactaccgttaccataaatgtgcccattaataatagacataccgtgagcataatctttcgcacgtacaacgcaaagaactggaccaaagatttcttctttataaatagtcatatcggttgaaacgttgtcgaataaggttcctcccacaaagtagccattttcatggtctgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttatacggacgaccatcaacgcaaagtttcgctccttgttctacgccttgatcaatatagctgatgatttttgctctatgttcttttgaaataacaggccccatatcattttcttgttgaccttctggtaaaattcctggtccaatttttaatgcttgtacttttggtaccaaggcttcaacaagtttatctgctgcttcatctcccacaacaacagcaacagaaagtgccatacaacgttcacctgccgcaccaaatgctgcaccaagtaaggtatttgctgtactttgaatatcggcgtcaggcataattaatgcatgatttttggctccaccaagagcttgtacacgtttaccatgagctgaacctttctcataaatgtattgagcaataggagttgaacctacaaaactgactgcttgaatacgagggtcggttaataaaatatcaacagcctctttatcaccttgaacaacattgaatacaccatcaggtaaaccagcttcttttaatagttcagctaaacgaatagatacagatggatctttttcagatggttttaatacaaaagtgttaccacaagctaaagcaatagggaacatccacatcggcaccattgctgggaagttaaatggtgtaataccagctacaacacctaatggctgctgcattgagtgaatatcaatacctcgtccagcatttgctgagaattcccctttttgtaagtgagggatacctgttgcaaactcaacaacttctaaaccacgagttaattcccctattgcatcagagtaaattttgccatgttccgttgtaattagacgagctaattcatcaaagtttgcttcaagtaactctttgaatttaaataaaattcttgcacgtcttaatggggactgttgcgaccagttaggaaatgctttatctgcagcttcaatagcttgattgacttctgctactgtactaagcttaacttttttgatttcttcccctgtagctggattgaatacagaagaaaaacgagagctggcactctctacttttgtaccattaatgaaattctgaacaaattggctcatgtgtgtgctcctatgaaatataaagtagaaggaattctagacaataacggtgcaaagctacctctaaaaaaagaaaatttcaagctaaaaatcattaaaatgaaaaatatatttcatttttgtgatcagtatagaaaaatgagcattttctaatacaaaaaagtgtagatattttttatagtacaggcttaggtcaataatatttaatgtgaggtatttatgagctatttactgtcaaaaagtcaaaaacacggacaaatccagcacattacaccagaaaacgcaaattgggagtatgtaggttttgatgcttaccttttgagtaaaggagaagaaattacattagagagtgggacaagtgaactctgtctagtgtttgttgcagggaaaggcaatgtaatcaccccaacagaagtttttgaaaatattgggaataggtctacaccttttgaaaagattcctccttatgctttatatgttcctcatcattaccaactaaaagttgttgctacggaagatttagaactggctgtttgtcgagcgcctagtaatggtgatttaccattacgtttaattacaccacaagagataggtgtagaaaaacgtggagtcggtaataaccaaagattagtacataatattttacctgaaacagagcctgctgatagcttattagttgtggaagtctttactgatgaaggcaatacgagttcttatccaagccacaagcacgaccaaaaagattctccaaatgaaacttatcttgaggaaacttattatcaccgttttgagcatgcacaaggttttgcaatgcaacgagtttatactgatgatagaagcttagatgaatgtatggcggtttatgataaagatgttgtgaaagtaccaagaggctatcatccagtagcgactattgctggctataataattactatttaaatgtgatggctggtcctgtacgtaaatggcaatttacgtgggaaagcgatcatgcttgggtaaacagtatggcttatagtgagaaattcaaatagatactctactgaaacatataatatctttccgtttaacctgcccgattttcctacatttttcaaaaaatcgggcaggttctttttgtgaaaaaaataatcaataaatgattttttttgtgacacctttcacaaaattaacatctcaatgtaaatccactttgaaaactgtcaactttgtacaaatatgctttccgttacctaggtaaaccatttttattattgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcctttctgatgaagaaattaaagttgttttaggcaaattctcaacttatagattgagagtagaagagaagcattgatagtactagagtaacaactatattattaaatatatgcttgcggatagtacttctccgtcaattgcaccaacattgccagcgagattgttggcaatgtggtggttaatcctcttgcctctatatcattttgtaacacaaaaactgtcttgttggtaaaaagttgtgggtattttaccgcttgtaatacgccatcttgccataacacgatagcatcatcaggggtaacttgttcaagaatagcgtttagtgttgataagtcatattgtgctttggaaaacgtatagagcatagtatgtccttagaatgtgagtactttttcggcttgatgcagggtatcaaataatgctgttcggctaacaaaacggagttcgggtagtatccattctgcgtgatgtagcccacgctcatctactgattgttggcagacaaaacattcggttaaatcatagagatcgattagcttgaatgtggatatgtgatctttttgtaaaatcatttcaggctgttgattagcaactagattgaatacgccatcattgagaaagcaaatggcaatttcatcttcattgcaaaaagcactggcagccaatagagcatcaagaccttctcggcttgttgatgtgccaaatgggggctgagtaaagagaatagcaagtttataacgtttcattttaaatagtcagtaatcgatctgcagtaaataccgcttggctaaattcaccaagacctgcaagggtaaaaccttcagcgagattttgctctacaatgccacgccgttgagcagctgcaatacagagatgtaacgacaagcggtgagattgggctaagcttttccaagcctcaaccaaattcagttcatcgctggctggatcaataagttgatttgcattgctaaccccatcttgaaaaaagaagatttgttcaattctatgcccttgagctaaaagtgcttgggcaacttgataggctagatacgccccttgtgagccatacaccccgtgttttactgccaacacatatcgcattattcaccgtcctgtttgagctggcgaatgtagagataaaccgtgtggcgagagatctctaagcggtcagcaacttggttgattgcatctttaatatcaaaaatacctttttcaaataaggcggtgacaatatggcggtttttattgctgttggaaatgttgcggtcgttttttatttcgacaatggtgctttcgatggtttgagccactaagtcttcgacagagcttgcaaaattcactgagccttcggtttcctgtggggcaataaaactatttaaaaattgcgatacagggacatcaagattgatattaatgcaaattaagccgataacgtgttgtttgccgttgcgaatagcaatggtgacagatttcatcaacaccccacctttggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttcatcaacaccccacctttggcacgggtgaaatagggtttggatacgctgtcggtttgcatatgatgaagtgaccataaagcccgatctgtaatcggcgagccaattttgcggtcggtgttatgcccattgacgatataaatcgcagagtgttctaagaactcaagggaatgcagtacgatttcgcaatgctcaccaatgagagctgcaataccatcaacaacgggaaagtaggaagccaaaatggcgtgatcttcatcagaaagcgggttgaattttgctgtcatactttgtcgctacataaaattaaaaataagggcacaaattgtgcccctataatgcgtttaagtaaacttattttgtagatttaaaatctaataattcgatttcaaattttaatgtggagttcgctgggatttttcctgcttgacggtcgccgtatgccagttgtggtggagcaacgatttccattttgccaccttttttcaacatagggattgcttcaacccaagctggaattaattgatttaattgaaactcaatcggctcaccacggtcgtaagagctgtcaaacacagtaccatctggtaatgtacctttataatgtacttttactgtatctgtcgcttttggagcttcgcctgagccagctttctcaattttatagagtagcccagattgagttttcttcacgccggatttttttgcatattcagcacggaatttatcgccagcctcaatggttgctttacttttttctgctaggattttagtttcttgttcaactaaataagcatctaacgcttttaattgtttttgtaaatcttcatcggttaacttaccgctttttttcaatgtgtcttgcacaccagctaaaacacgttcttggttataagaaaaaatctctttttgagaactaataacnnnnnnnnnnnnnnnnnnnnnnaatacaccaaaagcgtaagatgaatcatcaataaacttagcatcagctttnnnnnnnnnnnnnnnnnnnnnnnnnnnnnnnnnnnnnnnnnnnnnnnnnnnngcagacagtttgtttttaaacataaagtttccttgtaaaagtcattaaatagagtgttaaaacaaaggtagatagggtaaagtgtatttctttttaatacaacctttatattttgaaatgtcagaaaatttcaataagataactacctctttggcggagttagaaactaaaattgctttccaagatcatacgatcgaggaacttaatcaagctttaattacccaacagtttatgctagaaaaactgcagcaccaaatacgccatttggctgaaaaattgcacagtgttcagccaagtaatgttgcaagtcgtgcagaagaaacaccgccaccgcactattagagtgatatttagtgattttgttcaatggataacataatgaaatttagaaattggatctattttattagcttatggctatttatatcttcgctttttgcagaagaacctacaaaaacaccgctattccaagatggaaaaggctactattcttataaaaaaccactagatattttgttaccaaaagataatcgggttttaatcacttatttttatcagtatggttgtgaagtctgtttaaacggtgatgattatttaaaacaatatgcttctcgacattcagacaaagtggttttagaacgtgttgccgcttttagtgagaataaatatggaattacggtaagtttaaatgcacttttttcagaactgggaaaacctgaattaagcgagaagtatttatttgatagctcttatcaaaatgatcgacttattaccaatggtgaagcaataaccaaatggttgaataaacatcagatttcgttagacgccgttgagcaggtaagaaaacaggaaaattacccgaaaagaatttcacaaaattatgaattaataaaacgctattcaccgccagtcattcccatggcggtattgaatggtgaatatattttaactaaaagtactctttataatgatgattatacctacgccgtactcgactttttagtcgataaattacaaaaagagcaacaaggagtcacaaaatgaaaattggcatcataggtgcaatggcacaagaagtcgaaattttattaagttatatggcagagccgaaattaacggaaattgcaggttgtaaaatctacgaaggcaaaattaataatactgatgttgcattattgcaatcgggtattggtaaaaccgcctccgcaatgggaacggcattattattacaactggctaaacctgaaatggtgattaatacgggatctgctgggggtctagacgctaatttgaacgtaggcgatattgtcatttcaacggaagttcgtcatcacgatgtagatgtcaccgcctttggttatgaaaaaggacaactgccagctaatccagccgcctttatggcaaacgaacaacttgcacaaattgctatcaaagaaaccgagaaagcaggatttaatgcagtatctggtttaatctgtagtggcgatctgtttgtgaatggcagtgatatgattgctcgtattcgcaatgatttcccgtccgtaaaagccgtggaaatggaagccgcttctatcgcccaagtgtgtcacgcattccaagtgcctttcgttgttgtgcgtgcaatttctgatgtggcagacaaagaatctcatctctcttttgatgaattcttaccgcttgctgcagaaaaatcgtctgaaattgtgttggcaatgttgaataattttgcctaatcaaaacagcaagaggtaatttatctcgtaatatttgcaaattttaaccataaaaaaaccgcttgttgtcgaaatttatcttcaaattttgtacaattctgttcctttagcctatgctttgcataggcttgtttatttgattatctatattgttgagattgttttatgagttcagcaccaaatatcggctttgtgagccttggttgccctaaaaatttagtcgattcggaacgtattttaaccgagcttcgttcagatggttataacatcatttccagctacgaaggggcggatttagtgattgtcaatacttgtgggtttattgacagtgctgtgcaagagtctttggaaagtattggcgaagcattagaagctaacggcaaagtgattgtgacaggctgcttaggggcaaaagagaaccaaattcgtgaagttcaccctaaagtcttggaaattacaggaccacatagctatgaagcggtgatgaaacacgttcataaatatgtgcctaaaccagaatacaacccttatgtcagccttgtgccaaaacaaggcattaagctaaccccgaaacattatgcttacctgaaaatttcggaaggttgtgatcaccgttgtacattctgtattattccatcaatgcgtggtgatttagacagtcgtccaatcgtacaagtgctagatgaagcgaaacgtttagtggattctggtgtcaaagagctgttgattgtatcgcaggacacttccgcatacgctttagataagaaaaaagaagaaggcaccaaaacggttttctggaacggtatgccaatcaaaaacaacttgatcaccctctgtgaacaactaggttcaatgggtgtttgggtacgtttgcattatgtttatccgtatccacacgttgatgaccttattccgttgatggctcaagggaaacttctgccttatttggatattccattgcaacatgcaagtccaaaaatccttaaagcgatgaagcgtccaggatctattgaccgcacattagaacgcattaaaaagtggcgtgagatttgcccagatttaaccctgcgttcaacatttatcgttggtttccctggagaaacggaagaagatttccaaatgttattggatttcttaaaagaagcacaattagatcgtgtcggttgttttaaattcagccctgttgatggtgctgttgcaactgaaatggaagatcaagttccagaagaggtgaaagaagaacgcttccaccgctttatgcaattacaacaacaaatttcggcagatcgtttacaacagaaaattggcagaaccttgtcagtgattgtagatgaaattgatgaagaaggaataattggtcgctcaatggcggatgccccagagattgatggcgttgtctatgtagataacctttcaggtgcagaagtgaaagtaggtcaaattatttcagtaaccattacccaagcagatgaatatgatctgtggggaacttgttaaattttattaaggaatttgtataaattcacaatcagcgtagcttttcaatagctaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagatctgtttagaatttttccactctcaccctctatttatttagcacctgcaaccctcagataaggtactcaaatattaatgtaccactatagagctccttctgactcttcaaataatcagcataaatatattgtggagatgttcaaacaacgctacgatgcagatgcttcttctagtttgatttgaatgctccttactatagggttattttcttaatagttcgtatgtgaatcatggataaagtgtaacagtaaagatatttcttctaatttcaaaaaattcccaaaatttcatcgcttacacgttataatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaacatttttgaatgaatttttaggaaaaagacaatgacagcgaaatttaacgtgaaaactttccaaggtatgattttagccctacaagattactgggcaaaccaaggttgcaccgtggttcaaccattcgatatggaagtcggcgcggggacatctcacccgatgacttgtttgcgtgcgcttggccctgagccgatggcgtttgcttacgttcagccttcacgccgtccgactgacggtcgctatggcgaaaacccgaaccgtttacaacactactatcaattccaagtggtaatcaaaccatcaccggataacattcaagaactctatttagacagcctgaaaatgttaggtttcgacccaacgcaaaacgacattcgctttgtggaagacaactgggaaaacccaacgctaggtgcgtggggcttaggttgggaagtgtggctaaacggtatggaagtgacacaatttacctacttccaacaagtgggtggtttagagtgtaaaccggtaactggcgaaattacttacggcttagagcgtttagcaatgtacattcaaggcgtggacagtgtgtacgatcttgtttggtcggacggcccacttggcaaaaccacttacggcgatgtattccaccaaaacgaagtagaacaatctacttacaactttgaatatgcaaatacggatttcttattctactgtttcgatcaatacgaaaaagaagtgcaagaattattggcattagaaaaaccgttaccgttgccagcttacgagcgtatcttaaaagccgcacatagctttaacttacttgacgctcgcaaagcgatctctgtaaccgaacgccaacgctacattttacgcatccgcaccttaaccaaaggcatggcggaagcatactacgcaagccgtgaagcgttggggttcccgggttgtaagtaaaatctccccctaccccctctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcaaagagggggaatttgaatgaggtaataatgactaaaccaattttatatttcgcccactggtgccctgataccgccccgtttgtcgctgaattacaacgtcttggtattgactacgaagcggtagatattacccaaagcggtgccaattttaaaccgtttctcaaattgcgtgaccgtcaccctgcgtttgatgacgccaaagcaaatggctatatcggtattcctgctttggtgttggaagatgagagagtggtgttagagttgggggagttggagagattttgcaatcagtgattgcaaaattgaatttaatgcatcttactcaactttttttgttcttaacgtcccaataaagctagagaaataaggaaatttatgaaatacgcttttattgattatgaaaatgtgaattcattagacggtttaaatttacaggaatatgaccgcacttttttatttatcggctcggtaaataaccagttgcgtttgactgaaaaatttaatgatgaaataaacattaccttaattacggtaaaagatatttcaaaaaataacgtagattttcatcttgcttattatttaggcaaattagatataagcaccgataaaaatattgagtttcatattttatcaaatgacaaaggttttgatggtatttgccaatttattcaacaccaacgagaaccgagaatttgttttagaaaagcgattaaccaaactgaagaaaaaatcgctttgccgttattgcctaatcaagcaacaaaagtcaataatgcagaacaagagaagattagtcaggtagttcaagagtttaaggcgtttatatcaaaagtacaaaaacgtagtttgccagttaaattagctaccttaaaaaatagtatctataatcaaacaagtcttaaaggtgttgataaaaaggaagctgataaattattgcctaaaattattgatcagttggttcagaaaaagttgattaaggtaaatgaaaataaagtaagttatccttaatttttaacaagtaacaagcggtataatttcatagatcttttgcaaattttttcaattcggtacgcaatgcgtctcaaattcggaactcactgcgtaccgaattgaattagagttgaaagagcgaagcagagatttgttgaagctaaaagtgaataataatgcaaccttattcgagagatttaaaaccactttcgcaaaagttacgttctacacaaacggaagcggagcgtaagttatggcaaagaataaaccgagatcagctgttaggatttcgctttaatcgacaaaagccccttttaagctatattgtggatttttattgcttaaaggcaaaattggtgattgagcttgatggaagtcagcattatgagccggattatcaagaaaaagatcgtttgcgagatgcggagctaaattcgcttggctttacggtgatgaggtttgataatcatagtgtaatgacaaatattgatggtgtagtggaagcgatttatcagtatttgagtgagataaaagtggaagaaaaatagcgtaatttcttcggaaatagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgaaaatgaagtgagagatttatacttcaatataatttaggagcatataaaatgaattattggctagttggtgctactaggggtggtgaagaagaaatcttagattcctttattgaaaaaggttattggtactgttgggattctaaagattataaaccaaatcccgagggtttttctggaggtaactctataatacgccaacaaaactcatttagaaagatcaaaaaaggagatcgaattgctgttaagcgtttacaagggcaaggttcaaaaatgatggatattcttgcaatagggattgcaagaacagatgctgatgaaaatgaatggagggtatatattgattggattgcgatctctcctaatttattagaaaaagatgagtttaagaaacttgataaattaccaaatattgtatttccatctacaagagaaattgaaattggggagtgtagagcttctattcatggtccgtataagttagaagaaaataaagagtggattccaaaagtattctttatttaaagaatttttagcataagagattaataacaaaatgacaacacaaaacttcctcgccgagatcggcacagaagagttgccaccgaaggcactcaaaaaattagcgaccgcgtttgcggagaatgttgaagcggaattaaaccaagcgggtttgagctttgacaaagtggaatggtttgcagcacctcgccgtttagcggtgaaagtattggggcttgcgactagtcagccaagcaaaaaagtggaaaaacgtgggcctgcggtgtcggcggcgtttgatgcggaaggtaagccgaccaaagcagcggaaggctgggcaaaaggctgtggcattaccgttgagcaggcggagcgtattgctaccgataaaggcgaatggctggttcaccgtgcggtgattgaaggtcagccgaccaaaaacttgttagtcggtatgattagcaatgcgttggcgaaattgcctatcccgaaaacaatgcgttggggcgataaaaccgagcaattcgtgcgtcctgttcacacggtgaccttattgttgggcgatgagctgattgaaggcgaaattttaggtattgcaagcggtacgactattcgtggtcaccgtttcttaggcgagcgtgagttccaaatcagccacgccgatcaataccctgcgttgttgaaagaaaaaggctcagtggttgcggacttcaacgagcgtaaagcgttaattcttgcaaaagcccaagaaaaagcgaccgctttaggtggcgtggcggatattgaagaagacttgttagacgaagtgacgtctttggtggaatatccaaacgtgttggcggcaaaatttgaagagcgtttccttgctgtgcctgcggaagccttagtttacacaatgaaaggcgaccaaaaatacttcccgatttatgataaagagggcaaattgctaccgcactttatctttgtgtctaacatcaatcctgaagatccaagcaaaatcatcgaagggaacgaaaaagtggtgcgtccacgtttgaccgatgcggaattcttcttcaaaaccgatttaaaacagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttaaaacaacgtttggaagatcagttaccacgtttagaaacagtgttgttccaacaacaacttggtacattgcgtgacaaaaccgctcgcattgaacagcttgcgggcgaaattgcaaaacaaattggagcggatgaaaccaaagcgaaacgtgccggcttgttgtcgaaatgtgacttaatgaccaatatggtgtttgagtttaccgatacgcaaggcgtaatgggtatgcactatgcccgtcacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtatgcactatgcccgtcacgatggcgaagatgaagaagtggcggtggcgttgaacgagcaatatatgccacgttttgcaggcgatgagttgccgaaatctctagtggcaagttctgttgcattagcggataaattcgatacgctcacggggatttttggtatcggtcaagcgccaaaaggcagtgccgacccattcgctttacgccgtgcggcgctcggtgcgttacgcattattgtagagaaaaacttaccgcttgatctgagtgatttagtagcaacttcagcgaaattgtttggcgacaagctcaccaacagcaatgttgtagaagaagtggtggactttatgctcggtcgtttccgtgcgtggtatcaagatgaaggaattgcagtggacgtaatccaagcggttcttgctcgccgtccaactcgcccggcagacttcgatgctcgtgtgcgtgcggtgtcgcatttccgtacattagatagtgcagaagcattggcggcagcgaataaacgtgtgagtaacattttagcgaaagtagaaggcaaaatttcatcagaaatcgaccgcactttattagtggaagcggaagaaaaagcccttgcagaacaagtaattacattacaagcagagcttgtgccactgtttgaaaaaggcgaatatcaaaccgcacttgaccgcttagccggtttacgtgaagtggtggataacttcttcgataaagtgatggttaatgccgaagatccaaaacttcgccaaaaccgtcaagcaattctaaacaacttacgtaacttgttcttacaggtggcggatatttcgttactgcaataataacaaatgataaagccctattcacaaaatagggcttttttatggtggtagaatggatttagacaaattaattgagattgaccaaaagcacatttggcatccttattcatcaatgacccaacctatccctgtttatgcggtggaaagtgcaaagggcgttgaaatttaccttaaaaatggtcgaatgctcattgacggtatgtcgtcatggtgggcggcactgcacggctataaccacccacgtttaaacaacgcaatcacagaacaattagagaaaatgagccacattatgttcggcggtataacgcacgaaccagcggtaaaattaacggaaaaattgctgaccattttaccccaattattaaacaaaatattttttgccgatagcggttctgtggcggtagaagtggcattgaaaatggcattgcaatattggcaagcaaaaggggaagaacgaaatcaatttgccaccgtacgatcaggctattacggcgatacttggcacgccatgtctgtttgcgatcctgttacaggtatgcacggtttgtttcgtcaccgcttacctattcaacattttttaccccaaccttcgattaaatttgatgaaaaatggcaagaaagtgcgattgaaccattgaaagcattgcttgcacataaaggaaaccaaattgctgcattgattttagaacccattgttcaaggggctggcggaatgtatttctattcgccgatgtatttaaagcgagcgagagaactttgcgatcagtatggtgtattgctgatttttgatgaaattgccacaggttttgggcggacaggcaaactatttgctttagaatataccaatgttgtgccagatattctttgtatcggcaaagcattaactggcggttacttaacattagcggcgactattactaccgagcatattgctcataccatcagtgaaggcgaggcaaaatgctttatgcacggcccaacgtttatggggaatccactggcttgtgcggtagcctatgaatctctgtcacttttactggaaagcgattggcaacataaagtccatcaaattgaagcgcagctcaaggctgaacttgcaccggctaaagcgtttaaatccgttgctgaagtccgtgttttaggggcgattggggtgttggaaatgcgtgaagcggtcaatatggtttctttacaaaaacgctttgtagaaaagggaatttgggttcgtccttttggtaaacttatttatattatgccgccttttattatcgaacctaaccaattaagctttttaaccgagcaattattagccgtggtcaaagaggaatatggtgaataaatttactcaacatcttcagcaattagctgaaattgggcagaagcgccaactccctgatattgaacatcagggaaaatttgttgttgctcgtggtctgacgatgttgaatttatcgtctaacgattatttgggtttggcaaatgatgcacaacaagtggaaagatttttgcaatctatcggtaaaaatcaaccgcttacgtcatcatcttctcgtttattaacgggcaatttcccgatttatcaggattttgaaacgctattagcacaacgttttcagcgagaatccgctctattatttaatagcggctatcacgccaatatcggtattttgcctgcggtggcggataaacaaactttaattttagctgacaaattggctcatgccagtttgattgacggcattcgactttccggggcggattttttccgttataagcataatgattatcttcatcttgagcagctattgcagacacattcagagcgctaccaacaagtgattattgttacggaaagtgtttttagtatggacggcgatattgcggatcttcaacagttagttgcactcaaaaaacgttataccaatgtgctactgtatgttgatgaagcccacgccataggtgtatacgggcagcaaggtttaggaatggcagaagtcttcgactgtattcaagagattgactttttagtggggacttttggtaaggcattggcatctatgggggcttatcttgtttgtgatagcgagataagagaatacttaatcaatacgatgcgtcctttaattttttctaccgcacttccaccgattaatgttgcttggacttactttttatttgaacaattaccgcaatttactgaaaagcgtcatcatcttgagaaattaagccaaatcttgcgaactgaagtgacgaaaagaagtgaatttccgctgctaagcgaaacttgcatcgtgccatatatcttaggcgaaaatcagcaagcggtggaaaaagccgattatttgcaaaaacaaggctattattgcttacctattcgtccaccaacagtgccaaaaggcacggctcgtctgcgtttctcattaaccgcagatttaaccgaacaagatataatgggcttaattagctgtttgtaaaaggagaaaagcgtgcgttatcaacacattacacgccaacaacgtaaattacttgtctatttttctggctggggaacaccaatcagcattgcgaaatctttagagttaccgaacgattttgatttactgatttgttacgattaccgagatttgcatcttgaatttgatttttcgggctatcaagaaatttatgtggtggcttggtctctaggcgtttgggtggctgaacgtgttttacatgctatccctttaacttacgctgtggcgatcaatggaacgggggcacctaaacacgatcaatttggtattccaacggcagtgtttgacggtacgctttcatctttaagcgaagaaaatcttgtaaaatttgaacgcagaatgtgcggtaaaattgccctagaaaattaccgcttgttacctgaaaagcgagatttcatagaagtaaaacaagagttagcgcacttaaatgattgtattatgcaagataatcgaacggggttgttagtgtggcaaaaagccattattggcaacaaagataaaattatcccgccacaaaatcagcttgaatactggcaaaatcaaccacaaacaaaaattcagctcattgacgcagagcattatctttttaatcacttttccggttggcaaaaactgcttgagggtgtgacgtgcagttagtggataaacagcaagtcgctatccgattttcacaagcaaaatcggaatatgataataatgcgattgctcaacaatgtatcgtacaaaagctgatggcattactcgcaacccaaggcaaagcttttggcaaaatacttgaaataggttgcggcacaggtatgttaagtgaacaacttatgtcgcattgtgagtttgaatgtttagtactaaatgatctttgtcgcgattacgagcctgctttacgcaaaaaattaccttattcttcggtacattatcacttcggcgacgcggagcgggaaaatttcggcataggttatgatttggtgatttccgcttctgcaattcaatggtttgaaaatgaagcgaacttcctgaaaaagacggctaacatactgaatgatgacggtattttattgtttaatacattttcgcctaaaaatctttatgaaattaagtatctgcttaaaacgggattaacttatcccaccgaagacgaatggtataaattattagccgatgaatttgaagttcttgttttaacaatggaagaaattcccctttattttgattgtgcattatcagtactaactcatttgaataaaacaggggtaagcattattgatccgtctaaatggtcggacaatcgtctaatgcagtttgaacagcgttatcgtacgcgatttcagcaggatttaggcgttacattaacttatacgccactttatgtaatggctcgtaaaaaaaggaaacaacatgcttggtaaagtgatttttgtatcgggtattgatacggatgtaggaaaaaccattgcaacaggtttttatgctaagacattgcaggaacaaggtttttccgtgattacgcaaaaaatgattcaaaccggcggtgaaggaattgcggccgatattttagtgcatcgtaaaattcaaggcattgatttattgcctgaagataaagcaggtttaacttgccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgtttttccttatccttgttcgccacatttagcggcacgtttagcgcatacggaaattgatgaaaataaaattaccaatgcagtaaatcaattaagacaaaagtatgattatgttttgttagaaggggctggtggactggctgtgccttataccgaaacgagaaccaccttagattatttaaaaacacagcagtattcgctcattttggttagttcaggtaaattaggcagtattaatcacacattactcagtttgatgacgtgccaacaatatcaaattcctttagaagcactggtttataatcgttatcttgatcaagattcattgatcagtcaaaatacagaaatctatttattaaattatttacaacaacattttccgaaagcgaaatttattggtttagataaaatcgatatttaacacaacatattaagaggtaaaaaaatgtcagtcaaaagcgaagtgttattcagtaatcagtgggacgtacgtatcagcgatccagggttagaaggggcaatgagccactattttgaaacggtttatttaaatctcaccgctcacattgatgcgaacaaagtcagctacgaatttacccgtaaagtcgaaaatgaagtgcaaacccattgcatttttcacagtgttgatgaactgtttaaattcttggcggaatatcttgggccagttgcactgggcaatattggtgtaaaaattggtaagttaggtttggcttaattgtctatgagcaacttcctttaccatcaaacccaactgtattgggactttttacgcattgaaaagcaagtaagcccccatacgctcagcaattatcaacgccaactacgagtggtttgcgaaatgttacagcaagcagaagttactcgttggcaagagcttgatgcatcgacggtacgttggattttgtcacaaagccataaacaagggttaagtgcaaaaagtattggtttacggttggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcactacgtcagtttttggcgtttttggtgaagcaaggggaattaaaagtaaaccccaccttaggaataaaatcacctaaagccaataagcatcttcctaaaaatattgatgcggaacagatcgggcagttgctaaatatagacagtaacgaaccgcttgatctacgagatgtggcaatgatggaattgatgtacagctctgggctacgtttgtctgaattacaagggttagatttaggcgatatggatttacctaaccgtgaagtgagattgctcggtaaaggaaacaaagaacgtattgtgccaattggttctaaagcattagatgcaattgaacagtggcttgcagtacgtgggcagtttcagccaaaagacaacgccgtttttcttaatcagcgtggtgggcgactttcccaccgctctattcagttggcgatgaaaaaatgggggcagaagcaagcattggatacccaccttcacccccataaattacgccactctttcgcaacgcatatgttagaagcaagtcaagatttacgggcggtgcaagaactacttgggcacagtagtctttcgacaacacaaatttatacgcatcttgatttccagtatttggcgagaatttacgatttggctcatccaagagctaaaaggaacaagtattaatttagatatacattcaatactctatgatagtatacatatggagattaaggggtgaaaatgaaaaagtttgatgaactcgaagtggatgatacagaatttattgactctaaagatgcagagctagttgatattgacaataatgcctcaaatatttgtatcacaaataatatgttagtgcctcagggagcgacgctggatagttatattagaatggcaaatcaatatccagttttaacagctgagcaagagaaggagttagcggagcgcttttattatgatgaagatcttgatgctgctaagcagttaatcatgtctcatttgcgttttgttgtgtatatcgctagaggttacttaggttatggattaccgttagcggatttaattcaagaagggaacattggcttaatgaaagcggtaaaacgttttaacccagagatcggtgttcgtcttgcttcttttgcggtacattgggtaaaagcagaaatacatgaatatgttttaaaaaactggcgtattgtaaaagttgctacaacaaaatctcaacgcaaactattctttaatttgcgtaaaaataagcaacgtttggcatggtttaatgaagaggaaattagaaaagtcgcagaagaattgggagtctctacagatgatgtcaaagaaatggagtctagaatggtcggacaggatataggctttgatacctctgtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngataattatgttccctccatgtatcttgaagatgaatcttcaaattttgtagatgaattagaatatgaagagtatagcggaagggcaactgctcaattagcttatgcattagcacaactagatgaacgtagtcaaaatattattaaaactcgttggcttgatgaaaataaggctactttacacgagttagcggctcaatataatatttctgctgaaagggtaagacagttagaaaatcaggctttaaaaaaaattaaggatgtaattacttacgatataacatagtagacaaaaggcatatagaaaaaatacctagtgctttgaataaaacttggatactcaataatagggggggcactacgctatgccgaaaagctacgtccgtaaggagaggtaaggaggttaaagcatgcttcagcaattcttttatacattgagtgagatgaagctaaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttttgtctactatgcctaaaaaacaggctaatcatcattaacctgcgaattgatgaacacagcatagcaattttacatgttaattgataataattatcgttttatttgagtgctatattttgtcaaggtataatctttcattttaaagagaaagttgtatttgcggagcttgggtagcaaaatgaggaaaaacagcaacttccgctttataccatttttgaataatctcttttcggataacctctgttgcactgccacaggcttgaatgtgctgttctgccagtaaaatcagttgatctccatataacgcggctaaattgagatcgtgcaaaatacaacataccgttagccctttcttttggcatagatttttgagtaaacgtaggcagtgttgctgatggtaaagatcaaaggctgaggttggctcatctaaaaatagcaatttacctcgcatatcttcactccaaagttgtaacaacgctcgagctagttgtgtgcgttgttgttcaccgccagagagctgtcgataagccttatctcgcaaagccgcacattctgtcaccgtaatcacctcttctaaatgctgatcgacttccgtttggcttcgatgatagcctcccattctaatcacctcttctacagaaaaaggaaaattgagcagactatgttgtcgcattacggcacgatgttgagccaattcagctaaagagaattgatctatacctttattatacaaacgcacttctccgctttttgccgagaggtagcctgataataggcgtagcagtgtggatttgcccgcaccattaggaccaatcagcactgtcaccttaccttgtggtaacgctaaagagatattgtctaacaaaagacactgattaatcgttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatcagcgatcagcaagcggtctgattgcaacattaatttacctccctataacgaacgactaaccacagaaaataaggtgcgccaagaaaactggtaatcataccgacaggcaattccgctggtgcaaatgcagttcgagcaaaggtatcagcaataagtagcaagattgctccacaaagagccgaagcgggtagaacccaacgatgatcagcacctaatttaaagcgaacaaggtgaggaatgactaaaccgataaacccaatcgcaccactcactgctacggcagagcctactaataatgccccaagtaacatcaacagtcgttttagttgtagtacattaatgccaagataatgagcttcttcatcaccaagttgtaacacattgagcttctgagcgagagtaaacaaatataaacaggcgggtaaaatcagcgtacttgcaataaataacggctgccattgtgcttgtcctaaacttcccattgtccaaagtgtaaattgacgaagttgctgatcgttactgatatatgtcagcattccgacaatagcaaaacaaagtgcgttcactgcaatacctgccaataacaatttttgcatagaggcttgagtacgatgacttaaggcatagataaacccagttacagcaagactacccataaaagcaaaaagcattgtgctataaatgccccactctgttggtaaaatatttggcaacagaatagagagggcgacagcaaggcttgccccgctatttacaccaattaatgcaggatctgccatcggattatgaaataacccctgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaatgatggcgagtaaaatacgaggtaaacgaatatttaaccatatttgccacacgttactgtttaggtctgctgcaactaagtcttgccacgtcaaagaaaatgcccctacatttgttgcaataagtgccacaagcagtaatacgataagtagtgagatcagccaaagggaacgggacattatttcaccacttgttcagccgcagtacgcattttttgtagctcttgccccattgttaatccgaaagcaagaaacgcaatatcatcaacaacaactaatcgcttatgttttcctgcgttggtatgtgcaagtccaggtaatgtccaaatttcatcgggagatttaaaattttctaagctcaaatggctaagcacgattaaatcaggatttgctgaaatcattccttcttgagaaatcggagcaaatctcaccgcgtctttcattgcattttttgctccaattaaccgaatggcagtatctgcgactgtgccttttccagccgccatttgatgtatgccagctcgattgagaataaataaaatattgacatcaagtggagatttattgaccgcatttatttcttgggtaaatttatctgctaaagtagccgcttgttgtggcttaccgacaatgtcaccaatgcgtttgattttttctacgacactttcagggctatatttaagcggtacgagttccacctgaataccagcagatttcagttgttctaatacaacagacggctgtgcaacttcactcgcaatcactttagttggttttaatgccaaaataccttccgtgtttaactgtcgcatataaccaatatcgggcaatgctttcacctgtgggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaagacttgtactatcacgcccaattaaattttgttctgcatttaaggcataaataatttcggtgacatcgcccccaatgctgattactcgttcatttttagcttgtacagttgtcgaaattgcaaaacaagcggtgagaaagcagaaaaatcgaatgaatggcatataaacctcctaaatgataaaggttcttattttatattgttgagaattattatcaagtgattacataccccccactcacctgcttcactacgcccaacaactccaaattcagcagctcaatcaatgcggtttctaccgccatatctgttgctttggcaagatcatcaacgctgatcggctcaaggctaatctgttcaaacaattgttgctgacaagcggtcagttcaggtagtttttttgccaattttggggcagatttcaccgcttgtttaggtttcgtatcaaacaggtttggttgaatatgcactgattgccgttgccacgcaatcgcttctaaaatgtcgtcaatattttcaaccagtaatgccccttctttaatcaatttatggcacccttcgctatacgggttttgtactgcgttcggcaatgcaaagacttctctcccttgctctaacgcataacgggcagtaattagcgagccactattcactgttgcttcaataaccaatgttccgagcgataatccgctgataatacgatttcgtctaggaaaattctcagcaatcggtggctggctagggaaaaattccgacactaacgcaccgcttgtatcaacgatttgttcagcaagttttttatggcgagcaggatagacttggtctagcccactgcccaaaaccgcaatggtaattccgttttcattgaccgcacgctgatgacaaaatccgtctatgcctatggctaaaccactagtgacagcaagttgatatttcactaattccgccgaaaaatgccctgcccagtgttcgccatagtgggaataatctcgactgccaacgatggctatctgcggtaacgataaactttcaacattcccccgcacaaaaagcactggaggagcagtactgatctgcttcaataaaaaaggataatcttcgtcaaataaggttaaaatctgttgctgatcctgttctgcccattgcaatgcttgatcgatccatttatgctcaggattaaaccaacgctgaatttgccgttcattccagcccatttgctttaatgcggttttgtcatattgacaaaattcgccaaagtccacttccgagagtaaccgcccgatacgttgcgcgccaagctgtggcacttgtaacagggctaataattttgtgagatgtgtcatttattatttaccttatcgtagaaatattaaatttacttcgatctcactcccctctttagaaaagaggggttgggggagatttgacagaagtaaataacgaagaaaataatttatttggcaatcaataataaaaaaactaagggctttttaatcactcacttcgtttattcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaagagggggatagctagaggctagaaaaatatattaatggtaagctcccttctacatacatttccctaatcctaataaaaagtttaaaatagccaacatattctttttaatttttcgacggagatcgcaaaaatggctgttttagacgttttaatttacccagatgagaatttggctaaggtttgccaacccgtagaaacggtggacgcagaactaaatacctttattgataatatgtttgacacaatgtatgaacacgaggggatcgggcttgctgcaccgcaagtgaatgtgcttaaacgtgtgattactattgatattgaaggggataaaactaatcaaatcgtgttgattaacccagagattttggaaagtagtggagaaactggcattgaagaggggtgtttgtctattccaggttgtcgagctttagtgccacgcaaagagaaattgaccgttaaagcgttaaatcgtgaaggtcaaacatttacccttgaagcagatggtttgttagccatttgtattcaacacgagatcgatcacttaaatggtgtgttgtttgtggatcatatttcccaactgaaacgccaacgtatcaaagaaaaaatgctcaaactgaaaaagcagattgagcgtgcgaaataaaggagaagacaatgattattgtaacaggcggtgctggctttatcggtagcaatattgttaaggcgttaaatgctatcggtagaaccgatattttggtggtagataacctgaaaaatggtgagaagtttgttaatttagtcgatttagacattgcagattattgtgataaagaagattttattgcttctattattgcaggcgatgattttggcgaaattgatgcgattttccacgaaggagcttgctcagctacgacagagtgggacggtaaatatttaatgcaaaataactatgagtattctaaagagttgttgcacttctgtttagatcgccaaattcctttcttttatgcgtcaagtgcagcgacctacggcggtcgttcggacaattttattgaagagagaaaatttgaacagccgttaaatgtttatggctattctaaatttttgtttgatgaatatgtgcgtaaaattctgcctgaggcagagtcgccagtgtgtggctttaagtatttcaatgtgtatggtccacgcgaacagcataaaggctcgatggcaagtgtggcgttccatttgaatacgcaaattcttaaaggcgaaaatccgaaactatttgaaggttcggaaacatttttgcgtgattttgtgtatgtggaagatgtcgctcaggtgaatatttgggcgtggcaaaatgggatttcgggtattttcaatctaggttcgggcaatgcggagtctttccgtgccgttgctgatgcggtgctggcgttccatcaaaaagggcaaattgaaactattccattcccagatcatttaaaatctcgttaccaaacctttacccaagctgatttaaccaaactgcgtgcggcaggttatgataagccgtttaaaaccgttgcagaggggactaaggcttatatggagtggttgaatagataaaatgtaagcggtaagattgagctgaaatcttaccgctttgtcttttagatgtagtgagttccattaaaatcccaaatggagaaggtattttatgaaatataatctcatcgcattttctttgcttgcattacctttagtagctaaagcaaacccaacttgggtagatcatcaacgaataaaattacaagaacagcttgccagcattaaaacagcatttgagtgtcgtatttggtgatgaagatttagataaccacgctcaggatcaaaatcagttgcagcgtaattatcgnnnnnnnnnnnnnnnacataaaaagtatgatagtaaacagatacgaaatgataatgcgtctttagcattacgttggtctaaaggtgttaaagcattgggaattgatactgatgtggatttagggattcgttctgggacagacatattcttacgtttcaaagtagctaaaacctggcaacacaatgaggtattttctacccgattagagtaaatttatcgatacggtatagaaagcaagcactatctccgcactaattttgaaaataaattccagtggaagcctcaggtttttatcaataatcatacctttctacaatatactcgtgatttagatgagaatgttgaatcgggaaatagcttatatcgtcagcacgattttgcgggctataaaaaattgagctatggtttatttgttggcggtaacatcaataagaaaaaagcggctctaactcactacggacctttcatcaactggcagcaaccaatttggaaagactgagtgtttattcagcctgaagtccatttttacaatgataaaaaacaaaatcgtaaacaccatttcggcgcttttttacgactggaagcgattttctaacatcttttttaggcaaacaaagtaataatattacaaatagtgaaaatagcataatcagacgattaaatattatctaactatttactatcccgacaatattcttgtaaatttaattaatatcttatttatagtaataatctattcttgtggtcttgccagctttttatagaaaaaagggtagactaattctgttatgcaatccattccactcagaaagcgattattagaaggctatttttgttaggttggtttacgttgagagatgtgtagaaacttgagttggcggaggcgtatgggagttgaacccacccgagaacgctggcatcctcaacaggatttgaagtcctgccacatcaccggatatgacacacctccgaaaaagtggcactattctactgaatttattagaattgtgcaaaatttctgacggatctctgctatgcaatcactatttcgttcaattcctgcaattgataaactgctaaaaacatcacaaggtgctgatttaattcaacaattcggacatcaagcctttgttgctcaagctcgtttactgattgaacaagctcgccaacatattcagcaacatcaaagtctgcctgactttctacaaacagaacatacgctttttaacgaattaactcaccgcttgcaaagcctagctcaagtcaagatgaaacctgtgtttaatctgacgggaacagttttgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattggagcaaatatataattatatttcctatgaataattttgtataaagcccctaattcttaaagcccacaaaaaagccctacattcaaaaaatgtaaggcttattatttagtacatctgcttaacatcgcaatcatagatttttgagaagcgttctagcgtttttttctgtggcttgctgtcgcttcgttccatttgagaaatagccccttgagaaatccccactttgtccgctacttcttgctgtgataggttgcgataaatccgccacgctcctaaatggtttacgttatgtttaatcattatcataacaacctcatgaggaattaacgcatcgtcattatcgctttgctcgtagggtaggctttcccattcttcgtcatcctcctcctctatcctaaagccgtactcgtctacatctactaacttttcatattccgccataggtaaaatcacatataaaggcttaccgctgttatctctgatatattgtaaattgctcattatttcttgctcctgtgttttatagctctagttataagtccgctcgtctcgcttcttaatctcttggatttcgataataatcggtttattgttcactactttaaaaattaccctataaaatcccactctcattctaaacttgcctttgttttgctcgcctttcagttcgataatatctgcttgaacatttggaaattgttgtaacgcttcgattttttcaataattcggtcaaggtatcggctatcaatagttcttatctgtttgcttgccctgcttgcccatctaatcacagccattttataacccctaagattaccctttcaatagaataattataagatactctataaatatattcaatctttatcttataattatcttatttattagtaatgatcgaacctaaccaagcatcgtgcgtactgctccgaaaagcccccaaaatgtgtagcataaaaagggatattatccgcagaaaccaaaacgccaccccaccgccacttttacgctttcaaaaaaatttttttatatttagtaaaaaacagtagtccaattagtccaattagtccaatcctttaaaatcaaacacttaagtggcattttttggactaatcgagtagtccaatgtagtccaaaattagtccaaaactaacaaaatactcttattgttcattttttgagtagtccaaaatgccccaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaattttatgtaatatattgataaataaagatattatttttttaataggtattttggactaattggactactaaaaaactacgcgcatgaaaaaaaattttttttgcaaagataaaaaaagagctaaccatctctggaaagctcttaaatcatcaatgtagcatacagaccacaaaaagcacttaatgatatggtttgttatggtttttatgcttcatcactttcaacaagtgggaaaacgagataacatcttgtacgtttcggatctatcctgcttggtattcttactaagtatctatagccattttcgcccttagatagcattcctttatctgataggattttacaagcctgctcctttgcgtgtccctttatcgcttcctcaaaggctaatggatacagataaaagtgctctatctcattatctcgttgaggaatgattttatagcctgcgatattcgagatggctcgctgttcggggttgtttgggtattcgataaaccgcccctcagcatttgctaatagccagccgttcacctgctcaatgatttgtttctcttcttggctatgtagcccgaatatatttatccattcattgaagcagtgtagtaaggcttcaccgttggcggnnnnnnnnnnnnnngtgagaaagctcgctagctgtaaagcggtttcaaggatagcgaaacggctggccactcgttgaacctgtggacttgcgtcacttggcaagcggtctagccacttggcttttatttggctataaacattaatcagtgttttctgattgtccgccactgttagccactcaatccacgccctgccaacggctccgtagtgttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtggtcggaacaagcgatttcagctgctaccagtgcaatgcgaaataatgtggctctagagtttgatattgaagcaggtaaacgcagtcatcgtgatctctatgtttctgagctgttacaacaactgacaggggcggaagcggcttgcgtggtcaataataatgccgcagccgtattgctaatgttggcgacttttgctcaaggcaaagaagtgattatctctcgtggtgaattaattgagattggcggtgctttccgtatccctgatattatggctcaagcagggtgcaagttggttgaagtgggtacgacaaatcgcacccatttaaaagattatcgcaacgcaatcaacgaaaataccgcatttttaatgaaagttcacaccagtaattaccaaattcaaggttttacttcgagtgtgagtgaagaagaattagtggcattagggcaagagtttaatctgcctgtgattagcgatttaggcagtggctcgctcaccgatatgcaagccctaaacctacctgccgagccgataatgcaacaaaaagtcgcttcaggtgtggatttagtttcgttttcaggggataaactacttggcggtccacaagctgggattattgttgggaaaaaagcctttatcgatcaacttcaacagcacccactcaaacgcgttttgcgttgtgataaagtgattttgtcaggcttagaagctacgctacgccactatcttttccctgatcgtttaacggacgagctacctacgttgcacttgctaacacaatcccttgattgcttgcaacacaaggcagaacgtttaaaagtagcattaagtaagcggttagattatcgttatcttttgcaaattgaaccgagtgaagctcaaatcggcagtggggcgttaccgacagaaaaaatcccatcgcttgccgtgactatttcggcagacaaacagagcgatttacttgaattagaaaaacagtttaaaacctatccaaacccgattattgctcgttttgcacaacaaaaaatgtggctagatgtgcgaagtgtggcggagtttgaggtgcttatttttatgttggaggaactatgatcatcgtcaccgcaggacacgtcgatcacggcaaaacatcacttttatacgccttaacgggcactcacaccgctcacttgccagaagagaaaaaacgggggctgacgattgatcttggctatgcttatttgccgattgaaaatgatattttgggttttattgatgttccaggccaccaaaaatttctgtctaatatgctggcaggtcttggcggtgtccaacacgctttgttggtgatatcttcagaagaagggattaaaccacagactgaagaacaccttgctattcttcgcctgttgaattttaagcagattattatcgtactcaccaaagcggacagagcagaagctactcgtataacccagctgatcgaacaattaaaacagcgttatccgtttttagcttcagcacatttctttgtgacttcggctcagacaggcgagggcattaagccgttaaagcactatctgatcagccttaatcaccaaagcacacaaatagataaaccgttccgctatgcgattgaccgtgtatttaatgtgaaaggtgcaggtttggtagtgacggggactgcagtcgctgggaaagtggctatcggtgatgaattttatctctcaaacggtcagaaagtgcggataaaaaacattcactctcaaaataacgaagcatcgatcggggtcgcagggcaacgtttagccttaaatatcgccaatgtagaaaaagagcagattgagcgtggcaactggattacgcagcaagatccccaatttgcttgcgaccgcattaccgttcgcctaacgacagcccaagctttaaaagaaaacagtgttgtgcatctctatcactttgccagtcacactaccgcaaaattaaatttactggatagaagccaatgtcttgctgatgataccgcgatagccgaactgattttagatacgccgttacacattgctttgcaagacaaacttattttgcgtagtggcgacgatagtcaaacccttgctggtgcggaagtgatcgaaatccactcaccaaaacgccataaacgtagcgaagcacgcttgagttatctctcacagttagctaactgcacgagctatcaagaacgtattgcactctacctgcaacataaagcggtgaatttaacccaactactgtgggcagagcagatttttattcgtgatttagaaaaactggcggaaaaatcggattactatctcaactctaatcacctgtttaacggggcatttaaaactcagatccagcaacacattgtagcgaagctcgaagagtatcatcaacagcatagcgatcagcttggggtgacaaaggctcgtttacatcgtattgctacgttagagttatcagaacaacttgcctttgccctcattgacgaactgattgccgataacactttggcacaaacacgcggttggatccatacctcaacgcatcgaattgagttcaatgatgctgaattgcaaatttgggcagaaatccgaccgctatttgaacgtaccaatcaagctttatgggtgagagatattgcttccgaactctccatagacgaaactgaaatgcgtgacttgctatataaagcagggaagttgggctatttagtgccgattgtcaaagaccgtttcctattacacgaacagatcagtgcatttgctcagcttatcaaaaatttcattgaacaacatggcgaaatttcggtaaatcagcttagagatgaaattcaatatgggcgtaaagtgaccgtgcaactgatcgaatacttcgaccgttcaggcttcttacgccgtaaggggaatgttcatttgttgagggatagggatacttattaggagctatagagagtactaccatgcacggagacgaggaataaaatctgagaattttatgatgtgaggctaaaaacttggcgtagtagtctcctcaattggttcatgatgatacgtggattgcttgttacacgtaatgtaaaataatttgagcgaattgatagcttaaattagtaagattaaattttgttcattgtcttgaggtgcatctgaaaaattccaaattgttttgagaaacttcgatcttaaaatttacagagaagctggttcccctctttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatacggcgaagtgagagaataaattagatataagacacataagagcatatttaggtttgtcagcggtccgctccccgatggaaacattgggttttgcatttaggaggataagagtttttatagacaaagccagcattctatttttgcaatagattgtccacagaatagtccgttttaagcaaatcaaccaaatttacgtctaaagcgtccgcaattttccccattgcatcaattgaaatcgctctttttcctcgttctacatcactaatataagctcgactaagttctgcatcaaaagcaagagcttcttgagaaatatcctttaatcggcggatttttctaagattattcgcaaaagtatggcggattggatggctagtaagatgttcatttttcatctttttagtattgattctagcactatattcatcaatctacttaaagatataaaacataaactatagtttatattattataattttagattaatatatgatcgcaaaaattgatttatagatgaattttgcaagggcgtatgctctttttaataatatcgtttaatttctctagaaggattcttataatgaaactctcaattacaaagaaaactgtattaatagttgcaatgttaagtgcagttacaacaacatatgcggcaatgggctttttaattagagaagaagtaagtggaacaaataaaatttgttactatgatgtactagaatcaactcgtactatcaatgttccatcgtattctgtatgcccagtatcacataatttctaatagttttatggcgttcactttgaatgccatttttttaataattaagtttttcaaaatttattgagtttcttcttgttgccaaaaaaacaccaaattgctataatccgcaatccgaatttcgcatactggctagatgaattttcgtctagccattttgtgcttgaataacattagctaaatttgcgtcgttttagtttggctaattaattgatttataagatgttgttatgaatttatagatcgcaagcggtcgctttcgtgcaaaattgtgcaaagaccgttcccccctgagctaacctctgcggtagtgatttttgaccctttgtgtgaactcagaaaacgacacctcgtatcattttttataatgccacttcctgccggtcttgaggcggattgtgaaaactcaaccaaacagaaaatcagaggctatatttaatggcatactcatattccgagaaaaagcgtattcgtaagagctttggcaaacgctcacaagttctgaacgtaccttatctattaacaattcagctcgattcttttgataaatttatccaaagagatcctgaaggacttcaaggtttagaagcggcattccgttcagtgtttccgattgtgagcagcaacggtgcaactgaattacaatacgtttcttacgaattaggcgaacccgtatttgatgtgcgtgaatgccaaattcgtggtacaacctatgcagcgcctttacgcgtaaaacttcgtcttgtgacctttgatcgcgaagcggcagcaggcacagtaaaagacatcaaagaacaaaacgtctatatgggcgaaatcccattgatgaccgacaacggtactttcgtgatcaacggtactgagcgtgttatcgtttctcagttacaccgtagtccaggcgtattcttcgattctgacaaaggtaaaacccacgcttcaggtaaagtgctttataacgcacgcatcattccttaccgtggttcttggttagatttcgagttcgatccgaaagacaacctttatgcacgtatcgaccgtcgccgtaaattaccggcaacaatcattctgcgtgcattaggctacaccaccgaagaaatcttaaatatgttcttcgaaactgcgactttccacattgaagacaacagattattgatgaccttagtacctgagcgtcttcgtggtgaaaccgcagctttcgacattgaagcaaacggcaaaatctatgttgaaagtggtcgtcgtattaccgctcgtcacattcgtgcattagaaaaagacaatattactcaaatccaagtgccgaccgagtatatcgtaggtcgtgtgacagcgagagattacgttgatctttcaacaggtgaaattgtttgcccagcaaacagcgagatcggtttagaaacccttgcagcattagcacaagcaggttacaacgagatcgaagtattatttactaacgatcttgattacggtccgtacatttctgaaaccttgcgtatcgatccaacttacgaccgtttaagtgcgttagtggaaatctatcgtatgatgcgtccaggtgagccaccaacaaaagaagcggctgaagcattatttgacaatatgttcttctcaaccgaccgctatgatctttctgcggtaggtcgtatgaagttcaaccgttctttagatattcctgaaggcgtaggcacaggtatcttaagcaacgacgacatcattggtgtaatgaagaaattgatcgaaatccgtaacggtcgtggtgaagtcgatgatattgaccacttaggtaaccgtcgtatccgctcagtgggcgagatggcggaaaaccaattccgtatcggtttagtgcgtgttgaacgtgcggtgcgtgagcgtctttcattaggcgatttagatggcgtgaccccacaagatttaatcaatgcgaaaccaatttctgcggcagtgaaagagttcttcggttcatcacaactttcgcaatttatggaccaaaacaacccgctttcagaagtcacccacaaacgtcgtatttcagcgttaggttcgggcggtttaactcgtgaacgtgcaggctttgaagtgcgtgacgtacacaccactcactatggtcgcttatgtccgattgaaaccccagagggtccaaacatcggtttgattaactcgctttctgtatatgcacgtaccaacaactacggcttcttagaaaccccattccgtaaagtcgtgaatggtcaagtgactgaagagatcgaatacttatcagcgattgaagaaggtgcttacgttatcgcacaggcgaactcaaacttagatgagaacttccgctttaccgatacttatgtgacctgtcgtggtgaacacggtgagtctggtttatatcgcccagaagaaattcactatatggacgtttcaacgcaacaagtggtttctgtggcggcagcattaattccattccttgaacacgacgatgcgaaccgtgcgttaatgggtgcaaacatgcaacgtcaagcagttccaacattgcgtgcggacaaaccattagtcggtacaggtatggaaaaaccaatcgcccttgactctggtgttgcggtgattgcaaaacgtggtggtactatccagtacgttgatgcttctcgtatcgtagtaaaagtcaatgaagatgaaaccgttgcaggtgaagcaggtattgatatttataacttaatcaaatatacccgttcaaaccaaaacacttgtatcaaccaaattccttgtgtgaaattaggtgagccggttggtcgtggtgaaatccttgctgatggtccttcaacagatttaggtgagttggcgttaggtcaaaatatccgtgtggcatttatgccttggaacggctataacttcgaagactcaatgttagtctctgagcgtgtagtacaagaagaccgctttactacaatccacattcaagagttatcttgtgtggctcgtgataccaaacttggtgcagaagagatcacggcagatattccaaacgtgggtgagtcagcattaagcaaactggacgaatcaggtatcgtgtatatcggtgctgaagtgaaaggtggcgatattcttgtgggtaaagtgacaccaaaaggtgaaacccaattaatcccggaagaaaaattactccgtgcgatcttcggtgaaaaagcatcagatgttaaagatagttcgcttcgtgtaccaaacggcacatcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccgttatcgacgttcaagtctttacccgtgatggcgtagaaaaagacaaacgtgcgaaagacattgaagaaattcaattacgtgaagcgaaaaaagacttaaccgaagagttagagatcttagaagcaggcttgttcacccgtgttcgcaacctattacttgaaggtggcgtnnnnnnnnnnnnnnnnnnnnnnnnnnnncgtgaaaaatggttggagcaaacctttgaagacgaagcaaaacaaaaccaacttgaacagcttgcagaacaacacgaagaactacgcaaagagtttgaacgtaaacttgagatcaaacgcaacaagatcattcaaggggacgatttagcaccgggcgtattaaaagtggtgaaagtgtatcttgcggtgaaacgtcaaattcaacctggggataaaatggcaggtcgtcacggtaacaaaggggttatctcaaaaattaacccagttgaagatatgccgtatgacgaaaacggtcagccggttgagatcgtattaaacccattgggcgttccatctcgtatgaacatcggtcagatccttgaaactcacttaggtctggcagctcgtggtatcggtgaccaaatcaacnnnnnnnnnnnnnnnnnnnnnnnnnttgcgaagttacgcgaatatatccaaaaagcctatgacttaggtcacggnnnnnnnnnngtagatttaagcaccttctctgatgaagaagtgatgcgtttagcacaaaacttacgcaaaggcttaccgcttgcaacaccggtatttgacggtgcacacgaaagcgagatcaaaggcttattagaattaggtggattaccgacatcaggtcaaattactttatatgatggacgtaccggtgagaaatttgagcgtccggtaaccgtaggttatatgtatatgctcaaattgaaccacttagttgatgacaaaatgcacgctcgttcaacaggttcttatagtcttgttacccaacaaccactcggtggtaaagcacagctcggtggtcagcgtttcggtgagatggaggtatgggcattagaagcatacggtgccgcttacaccttacaagaaatgctcacggtgaaatcggacgacgtaaacggtcgtacgaagatgtacaaaaacatcgtggacggtacacactatatggaaccgggtattccagagtcattcaacgtaatcacgaaagaaatccgtgcattagcgattgatatggagttggatgaagcgtaagaacgacaatttgtagggacgcactgcgtgcgtccgtggacacactcagtgtgtccctacattcgttcccacaagcggtcaaatcttgcaaacaatttgccaacaccgaccgcttgcaaccaaagattttcagttgaaatgggcgaccatttcaagaacaaaaacctcaaatcaggggcaaaaacgtgaaagacttagttaagtttttaaaagcacaatctaaatcgaacgacgatttcgatgtgattaaaatcggtttagcatcaccagacaaaatccgttcttggtcgtttggtgaagtcaaaaaaccagaaaccatcaactaccgtacattcaaacctgaacgtgacggtcttttctgtgcgcgtattttcgggccggtaaaagattacgaatgtctttgtggtaaatacaaacgcttaaaacaccgtggtgtgatttgtgaaaaatgtggcgttgaagtcacccaaaccaaagttcgccgtgaccgtatgggacacattgaactggcttgcccggtggcacacatttggttcttaaaatcacttccgtcccgtatcggcttaatccttgatatgccgttgcgtgatattgaacgtgtgctttattttgaaagctatgtcgtgatcgaaccgggtatgacggatttagagaaaaatcagttattaaccgaagaacagttcttagacgcagaagagcgttggggcgacgagtttgaagcgaaaatgggtgcagaaggtatccaagcgttactcaaagacttagatttagaacatcaatgtgaaatgttgcgtgaagagttacaagaaaccaactcagaaaccaaacgcaaaaaaatcactaaacacttaaaattacttgaagcattcattcaatcaggcaacaaacctgaatggatggtaatgacggtattaccggttcttccaccggatcttcgtccattagttccgcttgatggcggtcgttttgcgacatctgatctgaacgatttatatcgccgtgttattaaccgtaacaaccgtttaaaacgtcttttagacttaatcgcaccggatattatcgtgcgtaacgaaaaacgtatgttacaagaatcggttgatgcgttattagataacggtcgtcgtggtcgtgcaattacgggttctaacaaacgtccattaaaatcacttgcggacatgatcaaaggtaaacaaggtcgtttccgtcaaaacttattaggtaaacgtgtagattactccggtcgttcagtaatcaccgtaggtccatacctacgcttacaccaatgtggtttaccgaaaaaaatggcgttggaattattccgtccgtttatctactctaaattagaaagccgtggcattgcttcaacgatcaaagcggcgaagaaaatggtagagcgtgaagatccgattgtatgggatattcttgctgaagttatccgtgaacacccgatcctgcttaaccgtgcaccaacacttcaccgtttgggtatccaagcgtttgaaccgttgttgattgaaggtaaagcgatccagttacacccacttgtgtgtgcggcgttcaacgcggacttcgacggtgaccaaatggcggtacacgttccattaacgcttgaagcacagttagaagcacgtgcgttaatgatgtctaccaacaacgcactttcaccggcaaacggtgatccgattatcgtaccatctcaggacgttgtattaggtctttactatatgacccgtgagaaagtaaacggtaaaggcgaaggaatgtacttccttgaccctcgtgaagcagaaaaagcataccgtacaggtcaagcggaattacactctcgtgttaaagtgcgtattactgaatatgagaaaaacgcaagcggtgagtttgaagcaacaaccagcttagtcgataccactatcggtcgtgcaatcctatggatgatttcaccaaaaggtatgccgtttaaactgttcaaccaaactttaggcaaaaaagcgatttcaaaattaatcaacgaaagctaccgccgtttaggtttgaaagaatcagttgtattcgctgaccaaattatgtacacaggttttgcatatgcggcacgttctggttcatctgttggtattgatgatatggtgattccagcacagaaatacgaaattatttcagctgctgaagaagaagttgcagaaatccaagagcagttcaactcaggtcttgtaaccgcaggtgagcgttataacaaagtgatcgatatttgggcggctgcaaacgaacgtgttgcgaaagcgatgatggaaaacttatcaacggaagaagtattaaaccgtgaaggtaatccggaaaaacaagcatcatttaacagcatctttatgatggcagactctggtgcgcgtggttctgcagcacagattcgtcagttagcaggtatgcgtggcttgatggctcgtccagacggttcgatcatcgaaaccccaattaccgcaaacttccgtgaaggtttgaacgttcttcaatactttatttcaacccacggtgcgcgtaaaggtcttgcggataccgcattaaaaacagcaaactcaggttacttaacccgtcgtttagttgatgtggcacaagacttagtgatcgtagaagacgactgtggtacacacgaaggtatcgtgatgaccccacttatcgaaggtggtgacgtaaaagaagcattgcgtgatcgtgtattaggtcgtgtggtagctgaagatgtcttaaaaccaggttcagaagaagtgttaatcccacgtaacaccctaattgatgaaaaatggtgtgatgtgattgaccgtgaatctgttgatgtgatcaaagtgcgctcagtcgtaacctgtaacacagacttcggcgtgtgtgcgaaatgttacggtcgtgaccttgctcgtggtcacttaatcaaccaaggtgaagcgatcggtgttattgcggcacaatcaatcggtgaaccgggtacacagttaacgatgcgtacattccatatcggtggtgcggcatctgcagctgcaaaagaatctagcattcaagtgaaaaatgcaggaacgatcaaacttaccaatgcgaaatcggttacaaacaaagatggcaagttagtactaacttctcgtaacaccgaattaactgtggttgatgcgttcggtcgaactaaagagaactataaagtgccttacggtgcggtgctttcaaaagcagatggtgcagaagtgaatgcaggcgaagtggttgctaactgggatccacatacaatgccaatcatctctgaagtaagcggtttcatcaagttcagcgacattgtcgatggcttaaccgtaacacgtcaaaccgatgaactcacagctctttcatctgtggtagtacaagatgtgggtgagcgtgcaacggcaggtaaagatttacgtccagcattaaaattagtcgatgcacaaggcaacgatattttaatcgcaggtaccgatgttgcagcacaatacttcttaccaggtaaagcaattgttaccttaaacgacggtgcagaaatctctgtgggtgaggcattagcgcgtattccacaagaatccacagcgactaaggatattacgggtggtcttccacgcgttgcagacttatttgaagctcgtaaaccgaaagagccagcaatccttgcggaaatttcaggtatcgtttcatttggtaaagaaactaaaggaaaacgccgcttgttaattactccagcagagggcgaaacacacgaggaaatgattccgaaatggcgtcagctcaatgtgtttgaaggcgaaatggtacaacgtggtgatgtgatctctgacggtgcggaaacgccacacgacatcttacgcttacgtggtgttcacgcagtaactgaatacatcgtaaacgaagtgcaagaagtttaccgcttacaaggggtaaaaattaacgacaagcacatcgaagtgatcgtacgtcaaatgttacgtaaagcggtaattaccaacgcttacgactctgagttcttagaaggcgaacaagtggaagtggcacgtgtgaaaatcgctaaccgcaaacgtgttgctgaaggcaaaccagaagtggaatttgaacgtgaattgcttggtattaccaaagcatcacttgcaacagaatcattcatttctgcagcatcgttccaagaaaccactcgtgtgcttaccgaagcagctgtggcaggtaaacgtgacgaattacgcggcttaaaagagaacgttatcgtcggccgtttaatcccagcgggtactggttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacgcgcaaaacgtcgtagcgtagatggagaaatcagcgtcgcacaagcggcagtttctgcttcttcttttgcaactgaggaagacatcgaagctgaaacccaaagctttgttaatgacgaagcaacccaaaaccttgcagcattattaaatgcagggtttgatggtgatgatgaagagtagtcacttataggtgggctttgccccaccgttgttaaaatggaaaagccctcagaactgtgaagttttgggggctttttgatgcagatagttttacattatgaagagcaatttgtattgttcaataaaagatatttttcttagaatggaaagtcaaacgtacccaaagaaagcatttacataaaaatacaggcatagtagacaaatttgtctactatgctcatagtgagaaactctctaaaggattgaagcattattgaacatttttataatatttaagtatcctacctacataaattgcatttttccgtctttgataaaaaatgaagtggcattgtcctgtcttttcccttgtattggttttagctgttcttgggtaattgcagtaacaaaaacttgtgaaccgctttgatacagtcgatcagccagtaattcgcatttttgagtgtcaagttcagaggcaaagtcatcaattaaaaagatacattgacgatttttttgagcaataaaatactctccttgcgcaagccgtaaggcacacatcaataatttaagttgccctctagaaagtacgtcttctactggtaatccgttagctcggaagcgaaaatccgctttttgaggaccgaccatagtatatccaacggatctgtctctttcaaagccttgtgctaaaagatcggcgtaatctctctctttttcccacccttgatagaaagttgctgtaatttctaattcaggtaaaaagaattggcagtttttttcaatgtaggtaagaatagattcggcatagacagccctagattggctaactatttgtgcaaatttgctaagctcgacatcccatggctttagttcattataatgacgagtttgtacaagggctgcatttcgttgttttagtagtcgttttaggctattccaattatgatagaagtcagtattttgatggaacaacccccaatctaggaatgctctgcgatatattggtcctccattgagcaatgttaaaccttcaggggtaataacctgcattggaagaagataggctaggtcagcgatctttttattactttccccattgattcttaatatagtttctccttgacgatttttttgtaaaccgacagagcattcgtgtttttcttcttggattttgccaaataaagtgaattcttcttggttgtacttaatgattcgattactaatatgacttttaaaggatttaccgtgaccaaggtagaaaattgcttcaagtaggctggtttttccacttccatttgctccaataaaaaagttaaagccgtggttcagctcaagatccacagctgttaaatttcggaaattattaataattaaacgagatagggacatgcaaagattacttttaaatcacataataatctatgtattagtttattgagttagtaatggataatcccaccaaatatcaaacaaattactcacttcgatttcaactaagccattagcttctaaccatttttgcactaattgacggtgagattcatcacatttacctaatttttctaagcaaattaaaccttcccaatgcaaatagccgctgccttcataagctaagccatttgggcgaattacttcatcaatgaaacgatcaacagttgtatcaatttggtcaataccagtaccttctacaaattggaatttcactaaaaagcctaattcttggaactctgctaagtgcatttttttacgctgtctgcgattacgaattggttgagccattttctttctcctatttgagtaacattatttcttaataaaatataaatcccacacaccgtgtcctaacttatgtccacgttcttcaaacttagttaaaggacggaaatcagggcgagggataaaatcgttggtttctgatgtattttgcaatgaagcatcaaattgacgtaatacttctagcatatgctcggcgtagttttcccagtctgtcgcaaaatggataaaaccattcggcgacagtttggttaatacacgggtaacaaattcaggttgaacaatacggcgtttatggtgtttcgctttttgccacggatcagggaaataaagctgcaatccacctaatgatccatcagcaatactatctcgcaaaatctctgtcgcatcgtggcagatcactcgcagatttttcacgcctttttccaacgcataagcgatacaagcaccaacccctggtgtgtggacttcaatcccaatatagttgcgatcaggattttgttctgccatttccacgagtgaacgccccataccgaagccaatttcaagcactacaggattgccgttgccaaaaattgcctcaaaatcaaaaggcgtattttgataatccaaaccgagattttcccagttattattcatcatatcacgctgataatcgctcaaacgccccgtacgcagtacaaaactacgcactttacgaagatagcgaccatcagcagtaaattcagcacgttcaacggttttacgttttttatcggcaaaagtaattttttcagacattttaatgttcgccgattaaaatctaacaagggcagaaccccaagtccaaccgccaccaaaggcttcaagaagcaatagttgcccacgtttaatacgcccgtcacgcaccgcttcatctaaggctacgggaatggttgcagcactggtgttgccataacgatctaaggtgatcacaacctgttccatatccatctctaattttttcgctgttgcactaataatgcgtaaatttgcttgatgtggtacaagccaatctaactgagctttttccaaattatttgcggttaaagtttcttctaccacatcagaaagctgcttcacggctaatttaaaggtttcgttcccttgcatttcaatatagccagattgcttatcgccacgttgagcataaggcaacactaacatctcatttttttcaggggaagcgtgtaaatgcgtagaaataataccctgttcagtacttgcttctaaaataactgcacctgcaccgtcaccaaataagatcactgtgctacgatctgtttcatctaaattacgcgagttaagatccgaaccgatcactaaggcttttttcacttgtcctgtacgaacgaactgatctgcaacacttaatgcgtaaacaaatccagtacaagcggcggctacatcaaaagcaattgcatcttcaatgcctaacaaaccttgaatttgacaggcagcacttggataagcgtgagaattactggttgttcccaccacaattaaattgatctcttgcagatcgatattggcctgttccaaacatttcttagctgcttcaaagcccattgttgcaacagtttcatcggctgcagcaatgcgacgttctttgatacctgagcgagtaacaatccactcatctgaggtttctaccattttttctaaatcagcatttgtacgaacttgggtgggcatatagcttcccgtcgctaaaattttgctgtacatatttttttctcaacttttctagattgctagatattataactataaccctctaaaaatagtaggggataggagcgattataaaggtaaatcattctcgacaatccgcaaaaaatcactaaaatcataccgcttatatcaaaaggaaattcaatgaaactcaatactcaacaacaacaagcggtagaatatgtcaatggggcttgccttgtgctggcgggtgctggttcgggcaagacacgggtgatcatcaataaaattgctcatctgattgcccgttgcggttattcgccgaagcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgataattttccttaggaaaggaaaatatgagataaattactgcttctcttgggcaaagcgtgcaatttcacgcatttgttccattgtttcagtacgagccaaaataccgtgttcacccataattttagcgaaaacacctggtacagtttgaacgctgataatattacctgcgtatttttggcatacttcatcaatggtgtgtttgtagtttttattcgctttacgtgcgatataaaccacattccaagggtgtgtaatgtttgagtagaatttgttctctttaacgatatttgcgtactctctgaatacgtcaaaatcgtttgcatagttccacatatcaatagttaaaccacctggtggacggcagttgatttcaagtggcattaattcgcccgtttttttcacacggaaatattcaaagtggaagaaacgttcacggactttgaatgcgtccacacatttctgtccgagtttaactaaatcttctttgatttcgcgtggaatgtagtagaacatatcgttatctttttcgacggtttctaatactacttcagaatactcaaggcttgagtagaacacgatattaccgtctttatcggttaaaccgtcaaaggtcacgatatcgccttcaataaactcttccataatatattcaatgtgggcatttttataaccaaagaaagcttctagttcgtctgccgatttgattttgtaggtatcgctcgccccaacacctgagtttggtttgatgatcacagggaatttgagttctttagccagtttgcgtgcatcttcatcgtctttaaacacacgacctttcgccacttttaagccagctttgcggaatacttctttcatttgtgctttggttttgattgccaacatatcttcgtttttatagccaggtacgttgaaatcagtacgcaatttcgcgtctaactcaagccagtattcgttgtgcgactcaacacgatcaatgcgaccgtatttgtgagcaaaatagccaaccgcacggtaaacttgttcgtagtcttccatattatcgacacgataatactcagttagtgagttgcgtaagccttcgcttaattgctcgtaaggtgtgtctgcaattcccaaagtattaaacccactttcacgcaatctcaccgcaaaggtttcaaaattggttggaaagtgaggggaaatcatcacaaagtttattggtttggacatagttcttactctaaatttgaacaaattataataagaatgtgtaagcggtgagattctaatcgaaatttggaaatattgatagaataaatggcatttctatattggaattaatataaaaatgcctttaaaaatgttttaaatataaatttgctttaaaagcaaacccatgttatggaagcagttatttcaaacttcccaccatatcttcagggcgtacccactcatcaaattgttcagcggtcactaaacccaagttgatcgcttcttctttgagtgttgtaccatttttgtgtgcagttttcgcaattttcgctgcattttcataaccgatatgggtatttaatgcagtcacaagcattagagattgatctaattgctgtttaatgcgtggatagttcggttcaataccgattgcacagtgttcatcgaatgatacgcacgcatcgcctaataattgtgcagattgtaagaagttgtacgccattaccggtttatacacgtttaattggaagtgaccttgtgtaccagcaaatgaaattgttacatcgttacctaacacttgcgcacaaaccattgtcatcgcttcacattgggttgggtttactttacccggcataattgatgaacctggttcattttcagggattaagatttcgccgatacctgaacgtgggccagatgctaataaacgcacgtcgttagcgattttgtaaagtgaaaccgctaattgttttaatgcaccgtgagtttccacaatcgcatcgtgtgttgcgagtgcttcgaatttgttttgtgcggttacgaacggtaaaccagtgaatttcgcaatgtagtctgcgactttcacatcgtagccttttggcgtatttaaacctgtacctacagctgtaccgcctaacgctaattctgccaagtgcggtaacgtattttctaacgctttgataccgaaagctaattgtgctgcataagcagagaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgttaatggtgttgcgtccattaagtgagtacgaccgattttcaccacatcttggaatgctgctgctttgtcagctaaagttttttgtaaacgttttacgcaaggaagggtatgttcaaccacttttttgtatgcagcaatgtgcatcgctgttgggtaagtgtcgtttgaagattgtgatttattcacatcatcatttgggtgaataatcgatttctcgccaagtttaccaccgtttaaaacgtgcgcacggtttgaaaccacttcattcacgttcatattagattgcgtacctgaacctgtttgccagattactagcgggaattgattatctaatttgtttgctaggatttcatcgcaggcttgagcgattaaatcacgtttttcagcagaaagtacgcctaaatcatggtttgcgtaagcggctgcttttttcaaataaccgaatgcttcaatgatttctttcggcattgatgcttctgggccgattttgaagttgttacgtgaacgttctgtttgcgcagcccaatatttatcagctggtacttgcacttcgcccatggtgtctttttcaatacggaatgtcattgttttctcctagtggaataaaataataaaatcaatgagtaaatcctagcattctaggaaaaagaaaggaatggaaattgctccattccttgtccgtttttttagtttttgtgatatggatcataaatccaatatggaattatattttatctagtattaaatcgctttcggagtccggcagcatacaaggcattatctgcatcattgagtaaattctgctttgttttgtctgaaatcgtatagatatattgtcgatttattgctccatgaagtcgaaataataaagcttgatcagcatcaacacctattttaaggaggttgacgaaaatatcaatctcgcccctatctactaaatcatcaatagagtagacacctagtttttttaatgtcctttcgagttgtattgtcatattcggcagcgtccgaatacattttttcttttccatatactgattttgtttcgtatggagaatatctttcacactttcgacgacccaatgtgaaacttgttgtaagtcattaagtagatcgggagggattaaatagaaggattttagattaatgccagtctgagagtcgagaagaagagataaatttttagctatgttttcctctaagcaatgatttggtatgtgtagatagaatttatcatctttgtataaagcaaacatagctttatctttcattattccataataggaaaaataggtttttgctttcgtttcgccaatgattgggtaaagaagattacggatatgttgtgtttttgcatcaatgtatttcatatacacctcaattaattatacatcttgattaggaaatgagcgttatttacactcaaataagataatcgcttttcagccaaataatgcaatgaaataacaagaatatttttgtgacactcgtcgaaaaatcagaaaaaaaaccaatatttagaataaaaaaacacctatttgtttgaattttgagcttttcgtgtttgtaaatttatggttatttaaggctgttgggcaaatttcacttgcaaaagataaaagagttaggtagaatctcgccacttttgacattgtagtctaagtcgcttggtgtaatcatttatcaagtggtattaccgataaggtagtacgtaacaatgtttccgatttggaaactataacaaggtatgactgtgccccccttaatttaatttgttaagcggtggttcagttttttattagctaaattttaatggagctctggtctaatgcagaaccaaagaatccgtatccgcttaaaagcatttgatcatcgtttaattgatcaatctactgcggagatcgtagaaacagctaaacgtactggtgcacaagttcgtggtccgattcctttaccaactcgtaaagaacgtttcaccgtgttgatttctccacacttaaacaaagacgcgcgtgaccaatacgaaattcgtacacacaaacgtttagtagatatcgtagaaccaacagaaaaaactgttgatgcattaatgcgtttagatttggctgccggcgttgacgtgcagatcagcctaggttaattaagaggttattacaatgattggtttagtcggtcgtaaagttggtatgacccgtatcttcaatgaagacggagtgtcagttccagttaccgttatcgaaatcgaagccaaccgtgtgactcaagttaaaactcttgaaaacgatggctatactgcagttcaagttactactggctctaaaaaagcaagtcgtgtaactaagcctgaagcaggtcatttcgttaaagcaggtgttgaagctggtcgcggtttatgggaatttcgtactgaaggtgaagaattcactttaggtcaagaaatcaacgtagacatcttcacagatgttaaaaaagtagatgttactggtacatcaaaaggtaaaggtttccaaggtggtgttaaacgttggaacttccgtactcaagatgctactcacggtaactctttatcacaccgtgtacttggttctattggtcaaaaccaaactccaggtcgtgtgtttaaaggtaaaaaaatggctggacacttaggtgctgagcgtgtaaccgttcaatcacttgaagttgttcgtgtagatgctgagcgtaaattattattagttaaaggttctgtacctggtgcaactaatagtgatgttattgttaaaccagcagttaaagcataagtctaggagatagagatggaattacaagttgtaggtgcgacagcactcagcgtttctgaaactaccttcggacgtgagtttaatgaagcgttaatccaccaagtagttgttgcttatgcagcaggtgctcgtcaaggtacacgcgcacaaaaaactcgtgctgaagtgtctggttcaggcaaaaaaccttggcgtcaaaaaggtacaggtcgcgctcgttcaggtgatatcaaatcaccaatctggcgttcaggtggtgtaactttcgcagcgaaaccacaagatcacagccaaaaagtgaacaagaaaatgtaccgtggtgcaattaaaagcattctttctgaattagttcgtcaagaccgtttagtggttgttgataaattcgaaatcgatgcaccaaaaaccaaagttttagtacaaaaattaaaagatatggcgttaactgacgctcttatcatcactgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcttatcatcactgcaagcttagatgaaaacctattcttagcagcacgtaacttatacaaagttgatgtacgtgatgtacaaggtatcgatccagtaagcttaatcgctttcgataaagtggttatcactgttgatgcagtaaaacaaattgaggagatgttagcatgattcaacaagaacgtttgctaaaagtgcttaaagcaccacatatctctgagaaagcgacaaataacgcagaaaaagacaacacaatcgtattcaaagtagcattagacgctaacaaagtggaaattgcgaacgcggttgagcaacttttcgaagttaaagtagattctgttcgtacagtggttgttaaaggtaaaactaaacgtcacggtgcaaaatcaggtcgtcgtagtgactggaaaaaagcttatgtaactcttcaagaaggtcaatcacttgacttcgttgaaggtgcggcagagtaatttcggaggaatagaaaactatggctatcgttaaatgtaagccgacctccgctggtcgtcgtcatgtagttaaagttgttaatactgagcttcacaaaggtaaaccttttgcagcgcttttagatactaaatctaaaacgggtggtcgtaacaacttaggtcgtatcactactcgtcacatcggtggcggacacaaacaacactaccgtttaattgacttcaaacgtaacaaattagacattccagctgttgttgagcgtttagaatacgatccaaaccgttctgcgaatatcgcattagtactttataaagatggtgaacgccgttatatcttagcaccaaaaggcttagctgcaggtgatacgattcaagcgggtgcttcagcgccaattaaagtcggtaactcattaccaatgcgtaatatcccagtaggttctactgttcataacgtagaattaaaaccaggtaaaggcggtcaaatcgctcgttctgctggtgcatatgtgcaaattatcgcgcgtgaaggtaactatgtaactttacgtcttcgttcaggcgaaatgcgtaaagtattagctgagtgttctgcaaccatcggtgaagtaggtaactcagagcatatgcttcgcgtacttggtaaagcaggtgcaaaccgttggagaggtattcgtccaaccgttcgtggtactgcgatgaacccagtagaccacccacacggtggtggtgaaggtcgtaacttcggtaaacaccctgttacaccttggggcgttcaaaccaaaggtaagaaaactcgtcacaacaaacgtactgataaattcatcgtacgtcgtcgtggcaaataattttttaattaattaaagaggataagccatgccacgttctctcaagaagggtcctttccttgacctacacttgttgaagaaggtagagaaggcggtggaaagcggggataaaaaaccaatcaaaacttggtcccgtcgttcaatgatcattccatcaatgatcggattgaccatcgcagtccataatggtcgtcagcatgttccagtttatgtttctgatgaaatgatcggtcataaattaggtgaatttgcaccgactcgtacataccgcggtcacgccgcagataagaaagctaagaaataagaggtaaaagatggaaactattgcaaaacatcgttacgctcgtacttctgcacaaaaagctcgcttagttgctgatttaatccgtggtaagaaagtttctgcagcattagaaatcttaactttcactaacaaaaaagcagcagctttagtgaagaaagttttagagtcagctatcgcaaacgcagagcacaatgacggtgcagatgtcgatgatcttaaagttgcgaagattttcgttgatgaaggtccaagcatgaaacgtgttatgccacgtgctaaaggtcgtgcagatcgtattttaaaacgtactagccacatcactgtggtagtgtcggatcgttaatcagtaggagaatagcaatgggtcagaaagtacatccacatggtattcgccttggtattgttaagccttggagctctacttggttcgcgaatacacaagatttcgctgataatttagaaggcgatttcaaagtacgtcaatttttaaacaaagagttagcgaacgcgtctgtatctcgtattactatcgagcgtccagcaaaaagcattcgtgtaactattcacacagctcgcccaggtatcgttatcggtaaaaaaggcgaagatgttgaaaaattaagaaacgcagtatctaaaattgctggcgttcctgcacaaatcaacatttctgaagtgaaaaaaccagagctagatgcaaaattagttgcagatagcattgctgctcaacttgagcgtcgtgtaatgttccgtcgtgcaatgaaacgtgcggtacaaaacgcaatgcgtttaggtgctaaaggtatcaaagttgaagtaagcggtcgtttaggtggtgcagaaatcgcacgttcagaatggtatcgtgaaggtcgtgtgcctctacatactcttcgtgctgacatcgactataacacagctgaagctcacacaacttacggcgtaatcggcgttaaagtgtggatcttcaaaggtgaaattcttggtggaatggctgcagtgattgaatctgagaaagaaccagcggcacagcctaaaaagccagctcgcaaaggtcgtaaataaggagatcactgaatgttacaaccaaaacgtacaaaattccgtaaagtacacaaaggccgtaaccgtggtgtcgcgggcggtacagaagtgagcttcggttcattcggcttaaaagcaattggtcgtggtcgtttaacagctcgtcaaatcgaagcagcgcgtcgtgcgatgagccgtgcagtaaaacgtcaaggtaaaatctggatccgtgtgttcccagacaaaccaattactgaaaaaccattagaagtccgtatgggtaaaggtaaaggtaacgtagagtactgggtagccttaatccagccgggtaaagttctctatgaaatggatggtgtatctgaagaagttgcacgcaatgcattcgcattagcagcagctaaacttccgttcaaaaccacatttgtaactaagacggtgatgtaatgaaagctcaagaactacgtaacaaaagtgttgaagagctgaatggtgaattagtgaaccttttaggtgaacagttcaaattgcgtatgcaagcagccaccggtcagcttcaacaaacccaccagttaaaacaagtgcgtcgtagcattgcacaagttaaaactgtattaaccgaaaaggcgggtgagtaatgactgataaaattcgtacagtacaaggtaaagttgttagcgacaaaatggacaaatcatttgtagttgctatcgaacgcacagttaaacacccaatttatggtaagtttatccgtcgtacaacaaaattacacgtacacgatgaaaacaacgaagctaaattaggcgatgtagttgaagtgaaagagtgtcgtccactctctaaaactaaatctcatactttagttcgtgttgttgaaaaagcagtagcttaatcaacaataaaaattaaaacccctagcagaaatgctggggtttttgtttttttcacgattgctaaatgtatcttttctttacatttatgtgttttccttaataaagtaaacttgtagcaaagctacacatttttatattaatatagagaattatttcaaaaatgttaactatatcacagatttttagtgtatttagtagtttaatacgtttgtgaaaatatggagggggtatatctaattttcatatattgctatgttgtttttttgctgtatccgtaaattttaattatttaaagaaaaggagaaaaaatgaaaagaagattatctaaaaatgttaaatgcagttttgtaccttcattgatttttctagcattagcatctaatttgcatgctactacgttctggaaaagcgatttaaacgagaatctaactcatataactaaacgagtaggtaaggataattttacggtagctgaagacggacgattatggccaggtataggtcctaatggagaggctcctggaacagtgcctctatattatagccgtattccagcaatgaccattacagatgataataaaatggttgttatgtatgatttaagatggaacagagcatatgatcaagatagaatcgatccaggagtatccatttcagaagatggaggaaatacttggttaagtaaaacagcttggacatttaatgattctaaaatgcctttgcgaagagctatggatcctacgattttgtataacagtatagatggtagtatctatgttatgcatgggacttgggctacaggtaatagaaattggtatcaagatcgtttcaactattttcaaaataatatttgggctacaaccatttataagtctatagatggagggaaaacttgggagaaaaatgctgaatttagtaaattaagtaaccccgatgttttttctaaagtaagtaaaggtccaaataacccagtagttagttttttaggaggtgttggttctggtattgtgatgcgtaatggaacattagtatttccaatacaaactgctcataattatggtattgcagcaaccattatgtattctaaagataatggaaaaacttgggaaatgccagaaacaacggatcttccagcaccgaatcaaagctctttagagaatatggtttttgagatggggaataaattaattatggttggaagggaggcgagagtaagaggaactcaagcagataaacgatgggcatactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacagaagatatgggtaagagttggcatgcttatgaacctgcgagttttggttctagtacagcccaaccaactcaaggctcatcaatttatgttaccttgccaaacggtaggagagtattgctcgtttcaaaacctaatggtaataatgatagctgggctaggggtaaccttgctctttggatgctagatgcaaaagatccacaacatgtatatgaggtggctattatcagacctggttctggaaataaagcgggtgcaggttattcatctttggcttataaagagggaaatttatttgttgcttatgaggatgatggaaatattactgtaaaaaatttgacacaatatatgacagatattcaagctaaagcccttgaatggaatcttcctgatgaaattgaacctgatgttgaaaaaattaatgctttaatgcatttgaatcaggggcaaaaagacgaattgattgctaaacttcgtagggcaaatgataatgcaatagcacagtctattacgcttgatcaggctatgtcagaattaaaactcaaaagctttgcattaagtcaacaagcggtttcttttgaaaaggctttaccatccaatcttaagaatttccaagatgcattagcatctattaatactatttcagaatctaagaatacaacaaatgtcaattatttaggtgttcatgatttatatgatagcttgtataccatgtttttagctttgaataatccattggactttaccaaatatattgagcaggctaagcatttaaatgaatacaaccatgatattttgtatcgctcctttgatgatgtttttgctcattatagtggaggttcaaaatataataagctctctttaggtggaaataagacggttagtgaaaaagttcaggctggattgttttttgaatatggcaataaacatcaaaaaagttatcacgttggtatgagaacaaaatatcaactggataatcatcagattgctggttttattcgttaccgtggcgtaaaacaccaagactttattgaacgtaataacaatgttgatctttatttgaactatgcttatcaacttagattgagtgaagatctgagtatgagcccttcgtttggtgcctatatttctcgttccaatagaacattgttagatcaggatgtcgctgttaataagagaacagtttatgctggagatgttggtgtgaatcttatgtataagataaatgatattaatgtaaatatccggccaaatattgcattcatcaatgacagtctgaaactatctcaatctaatgataagagtaatgtgtataaaattagttcacataatacaatttatggattggcaactagtattaataaagctttttcaaatggattgaaagtaggttcaacattagaattgcaaaaatatggtagtcaatattctaatgtaaatttaggtgtagatatcagttatacttggtaactagacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcattaccaaaagcgtaaacggtaatcctactttcacaaaatccataaaactatagccacttggtgcaagtaccatcgtattcacaggagatgaaacgggggtaataaaagaggctgaggctgaaatagcgacaatcattgcaaatggtactggcgaaaaatttagctgttgtgcgatagcaatggcaatcggcattactaaaattgcagtggctgtatttgagataaaggcattgatgatggcggtaaaaataaataacaccatcaacacaaaatgcacccctaagccttgcataatctcagtgagcatttgaacaatcagatcgatcccgcctgttttttgtaatgcaatggaaaatggcatcataccgacaattaaaacaatactcggccaatggattgattcgtaagcacttttcatatcaacacaacggaatttgcccaacatcaaacaggcaatcaaagccgcaatcacattcggcactaaccctgtaatcatcaacaccaccattgtgacaatcgaaaaaattgcgtgaggtgcttggctaatcgctggtgctgcgtgtttgctctcttcgggagctttgagtaggaagaagtcacggttattgtgatcgagtttgagcaaattattccatacccccataatcagcaaggtatcaccaaattctaacggggttgaaatcagattatcttcaatcaatgtatccccacgttttaacccgacgacacttaagccataggtagaacgcaatttaagttcactaatactttttccgatacttcctgcttcaggcataatcgaaaattccgccattccaacagattttgcgtgttctgagaaatagtcccctttcaactcaattatgcgtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctttttcttgcaaagtttccgtaccataggcggcaatagaaagcgttcttaaacgtttaacacgttgaatagcaacgatatttagcccatactcgcggcggagatttaattcattgatcgtttttccaatcaatgatgaaccagcatcgatcaccaccatttttgcccgcccagttaaattatattccgcaataagctgttgcattgatgaaccatttttattttcagtgcggactgtttcgccattatctaaccaacggcgagcaaaaagcatataaacaatccccagcaccaagaccgaaacgccaatcggtgtaaaactgaagaaaccaaaaccttgatgtcctgctttaactaattcagagttagccacaaggttgggcggtgtcgcaattaaggtcatcataccgctaataagcccagcaaaactcagcggcatcattaagcgtttcggagaaatccccatacccgaacaaattgccaacaccacaggaataaaaatagccacaatccccgttgaactcataaaagagccaagcccggcaatagataacatcaacaacactaaaaccttaacttcgcttgcccctgcaacacgcattagccactcactcacctgataggcaatccctgttcttaccagcccctcgcccacaataaagagcaaagcaatcaaaatcacattcggatcacttaatccagcaaacacctcattgaccgaaagaatgccacttagactaaaaaaggcaataacgagtaaggcaacaatatccattcgtaatttattgcgaatgaactgccaaattgcaaataccaataaggcaaacacccaaaacagtggcgataagagaaaatcagggagggaataaagtatcggttgcataagcattatcaaggaagttgaacaacagtttgattataccgattttcagaaaattaacagggagttttctcaaattccgctaaaaaatttggcatatctctattaggtgctctcgctagaatttaattggttatattgaagtgttcacaagagccctttgggcttttaccaacaaaattattaactttttcttaatagcatatgaaaatacattatgtcgcaaataatatcagggatatttatttctaaaagcataagaatgttaatttttttataaaaatgttaagtaaccgaaatttttgcagggtttacaggttggcaattttggtcaatctgcgtataattcggaagattttgattgcgtaactttagattagtttacacaaagaaatcgtttacttttttattaggttttagttaaaaatgtctgcggttcttcgacaaacgaaacaactttatcaaaaagcactcggtatcgagttaattctgctgttctgcatagcaggagcagtggggattgggttgggcttaaatcgctttatttcgttattattaggggaaattgcggcgttgcttccacattgtgtgtttgtgtattgggtgttttttcgtaaatcggtaataaatcctcaaaatatgaccgctttttatcgtggggaagggctgaaatggcttacgacgatcattgtgattgtggtggcgtttaaaagttatggtgctatgcactatgtttcgtttttttgtgggttcttttttataattctttgtaatagtcttctgcctattgcattgaagtggcattcaaaataaatttcttttaatttcaaaaggataaactatggctggtcaaacaacggctgactatattggtcaccacttatcgttcttgaaaacaggggacggtttttggaatgtgcatttagatactctgtttttctcattagtagcaggtgcaattttcctctttttcttctctcgtgtggcgaagaatgcaacagatggcgtaccaggtaaatttcaatgttttgttgaaatgattgtcgagtgggttgatggtttggttaaagataacttccacggtagtcgtgaggtggttgcacctttagctttaactgtgttctgctgggtgttcgtgatgaatgctatcgacttaattcctgtggattatccaccacaatttgcagagttattagggattgactatttgcgtgctgttccaacagcagacattagtgcaaccttaggtatggcgatttgtgtgttctgtttaattattttttacaccattaaatcgaaaggtttttctggttttgttaaagaatatacgcttcacccatttaaccactgggcatttattcctgtaaactttgtacttgagatcgtaacgttattggcgaaaccgatttctcttgcattccgtttattcggtaatatgtatgcaggtgagttaatttttatcctgattgcagtgatgtatatggcggataacttcttgcttcaagcattaggtttgccattacacttagcttgggcgattttccatattttggttattacgttacaagcctttatctttatgatgctaacgattgtttacttgagtattgcttataataaagcggatcactaaacaaactggattggtgagcggttacttttatgcaaaaaattgcaatgattagaccgcttatgaaacccgatcatatttattgaaacttttttattaaccctagccataaggctaatttccttacttttatggagaacattatggaaactgtaattacagcaactattattggcgcatcaatcctacttgctttcgcagcattaggtactgcaattggcttcgctatcttaggtggtaaattcttagagtcttcagctcgtcaaccagaattagcaagcagcttacaaactaaaatgtttatcgttgcaggtcttttagatgcgattgcaatgattgcagtaggtatttctttacttttcatcttcgcaaacccgttcattgatttattgaaataagtcggatttgtttttaaccgtagttactcaagagtaacttagccgacttaaggagggcgttgtgaacttaaatgcaacactaataggccaactgattgcattcgcactatttgtgtggttctgtatgaagtttgtatggccaccgcttattaaagcgattgaaacgcgtcaagcaaatattgcagacgctcttgcaagtgctgagaaagcgaagcaagaacaagctgatactaaagttttagttgagcaagaactcgctaaagctcgtgaagaagcgcaacatatcattgatttagcaacaaaacgtcgcaatgaaattttagaatctgttcaagcagaagctgaagcagagaaagcgaaaattattgagcaaggttacgcagaagtggaaaacgagcgtcgtcgtgttcaagaagaacttcgtcaaaaagtggctgcattggcggttgctggtgcagagaaaattgtgggtcgttctgttgatgcagcggcaaacaatgacatcattgataagctagttgcagaattataattaaggggggcagatgtcacaattaacaacagtagctcgcccctatgctaaagcagcttttgattttgctttagaacaaggtcagttagataaatggcaggaaatgttacagttttctgcattggttgctgaaaatgaagatgtgcaacattttattcattcatcttctgcagccactcaagttgccgatacctttatcgcaatttgtggtgatcaactcgatcaatatgggcaaaatttcattcgagtcatggctgagaataagcgtctttcggcgttaccttcagtatttgctagttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcaggcgttattattcgttacgatgatgttgtcattgatggtagtagtcgtggtcagttaaatcgtttgagccaagagttgtgcttgtaagaggaatagaaaatgcaactaaattctacagaaattagtgaattgattaaaaaacgtattgcacagttcaatgtggttagtgaagcacaaagtactggtacaatcgtttcagtcagcgacggggttattcgtatccacggtctcgctgatgtaatgcaaggtgagatgattgcattaccaggcaatcgttatgcgattgctttaaacttagaaagagattcagttggtgcagtagtaatgggtccatacgcagatttagcagagggtatggaagtgaaatgtactggccgtattttagaagtccctgttggtcgtggtttattaggtcgtgtagtaaacacattaggtcagccaatcgatggtaaaggtgaaatcgataatgacggtttctcgccaatcgaagtgattgcaccaggcgttatcgaccgccaatctgttgatcaaccagttcagactggctataaagccgttgactcaatggtgccaatcggtcgtggtcagcgtgagttaatcatcggtgaccgtcaaacaggtaaaacagcattagcgattgatgcgatcattaaccaacgtgattcaggtattaaatgtatctatgtggctatcggtcaaaaagcatctacaatttcaaacgtggtacgtaaattagaagagcatggtgcattacaaaatactatcgtggtagtagcaagtgcatcagaatctgctgcattacaatatttagcaccttatgcaggttgtgcgatgggtgaatatttccgtgaccgtggtgaagatgcgttaatcgtttacgatgatttatctaagcaagcagttgcttaccgtcaaatttcattgttattacgtcgtccaccaggtcgtgaagcctatccaggtgacgtattctacctacactctcgtttacttgagcgtgctgcgcgtgtaaatccagattatgtagaacgtttcaccaatggtgcagtaaaaggtcaaactggttctttaaccgcattaccaattattgaaacccaagcaggtgacgtttcagcattcgttccaacaaacgtaatttcgattaccgatggtcagatcttcttagaaaccagcttctttaacgcaggtattcgtccagcagtaaaccctggtatttctgtatctcgtgttggtggttctgcacaaactaaacttgttaagaaattagcgggtggtatccgtactgcacttgctcagtaccgtgaattagcagcctttgcgcagtttgcttcagatcttgatgatgcaacacgtaagcaactttcacacggtcaaaaagtaacagagttacttaaacagaaacaatttgaaccaatgtctgtggcacaattaggtttatcacttgcagcagctgaatttggttatttagatgatgttgaagttgagcgtgtaggttcatttgaatcaaatcttttagcttatgcaaatgcaaattatgctgagtttatgaaagatttaagtaaatcaggcgatttcaatgacactatcaaagcgaaattaatcgagattttagatagtttcaaaaagaatagtgcttggtaatctactttagcggagaaagaatatggcaggtgctaaagagataagaaccaaaattgcaagtgttcgtaatacacaaaaaattaccaaagcgatggagatggttgctgcatctaaaatgcgtaaaacgcaagaaagaatgtctgcatcacgtccatactcagatgccattcgtaaggtaattagccatattgccaaaggaagtattgattataaacatcctttcttaactgaacgtgaagtcaaaaaagttggttttttagtggtttcaacagaccgtggtctatgcggtggcttaaacattaatttatttaaaacagttttaaatgaattaaaaacacgtaaagataaaggaattgatkctsgcttaggattggttggaaataaagcggtttcgtttttccaatcaatgggattagacgtcaaagctcaagttacgggcttaggcgatactcctgcaatggaagatttagttggtattgttaacggtatgattgaagcttatcgcaatggcgaagtggatgaagtttatattgtttataaccgttttgtgaatactatgtcacaaaaaccaacgatgcaaaaattgcttccattacccgaacttgaaaatgatgatttggaaaataaaggctcatgggattatatctatgaaccgaatccaaaagtgttgctagatagcttacttgtacgctatttagaatctcaagtttatcaagcgattgtagataatcttgcttctgaacaagcagctcgaatggtggcaatgaaagcagcaacggataacgcaggtaatttaatcaatgagttacagttggtgtataacaaagctcgtcaagcaagtattacgaatgaattaaatgaaattgtcgcgggtgccgcagcaatttaacaatgaatagaggaacggtaatggcaacgggaaaaattgtacaaatcatcggtgcggtaatcgatgttgagtttccacaagatgcagtaccaaaagtttatgatgcattaaaagttgaaacaggtttaacccttgaagttcaacaacaattaggcggtggcgtagtacgctgtatcgctcttggtacatctgatggtttaaaacgtggcttaaaagttgaaaatacgaataaagcgattgaagtaccagtgggtacaaaaacacttggtcgtattatgaacgtattaggtgagcctattgatgaagcaggccctatcggtgaagaagagcgctggacgattcatcgtgcagcaccaagttatgaagatcaagctaacagcacagaacttttagaaacagggatcaaagttatcgacttgatcgcaccgtttgctaaagggggtaaagttggtttattcggtggtgctggcgtaggtaaaacggtaaatatgatggagttaatccgtaacatcgcaatcgaacactctggttactcagtattcgcaggtgttggtgagcgtactcgtgaaggtaatgacttctaccacgagatgaaagactctaacgtattagataaagtatcattggtttatggtcagatgaacgagccaccaggtaaccgtttacgtgttgcgttaaccggtttaaccatggcggaaaaattccgtgatgaaggccgtgacgtgttattcttcgtcgataacatctatcgttatacccttgcaggtacagaagtatcagcgttattaggtcgtatgccatcagcggtaggttaccaaccaacacttgcggaagaaatgggtgttctacaagaacgtattacgtcaaccaaaacaggttctatcacctcggttcaagcggtttacgttcctgctgatgacttaacagacccatcaccagcaacaacctttgctcacttagactcaacggttgtattaagccgtaacatcgcatcattaggtatttaccctgcgatcgacccgcttgattcaacatcacgtcaattagacccactcgttgttggtcaagagcactatgatgttgcacgtggcgtacaaaaaacgcttcaacgttacaaagagttgaaagacatcatcgcaattcttggtatggatgagttatcagaagatgacaaattagtggttgctcgtgcacgtaaaattgaacgtttcttatcacaaccattccacgttgcagaagtgttcaacagcgtaccaggtaaatttgtaccattaaaagaaacaattcgtggtttcaaaggcattttagcaggcgaatacgaccatatcccagaacaagcgttctatatggcaggttcaattgacgaagtggttgaaagagccaacaagatgtaattgttctttgaactaaggagaacaaaatgacatcatttgaactcacagtcgttagtgcagagcgtaaaatctttgaaggtcaagtaactagtgttcgagtttcaggggtagatggggaattaggtgtctatgcaggacacaccccactattaaccgccattaaacccggcatggtcaaattcactttggaagataacaaagaagaatatatctatgtttcaggcggattccttgaagttcaaccaacggttgtgactgtgcttgcagacgttgcaattcgtggtgaagaactcgatgaacaacgtatccttgcagcaaaacgcaaagcagaagaaacaataagcaaaacaaatgaagcggatatgaccgccaaattagctcgcgaaattgctaaactgcatgtttacgaactcactaaaacgaaattagcgaatagacgttaattttatatacagaaacgccttaatatgtttatattagggcgtttttatttctcagtaatttataaaggctcactatggcaacaatgaaagatatagctcgaattgcaggggtttcactttcgaccgtttctcacgtcgtaaacaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacgtcgtaaacaattcccgttttgtcagtgaagaaattactttaaaagtcaaaaaagttattgaggagctaaattatcgcccttctttggtagcaagaagtttgaagatcaaggaaaccaatacgataggaatgattgttaccacaagtaataacccyttttttgcagaagtagttcgtcatgtggaacgttattgcgaacgccatcattatcacctgattctagttaataccgacggcaacagccaaaatttacagcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttattaaagcaagttgatggcttattgctgatgtgtgcagaacctcaaaattttgacttaagtgcgattacccatttaacactcccgatggttgtgattgactggtggcaacaacctttaaatgccgatatcattcacgaaaattcagaactaggcggttatcttgcgacaaaagcattaattgatgctggttatcatgatatnnnnnnnnnnnnnnnnnnnnnnnnnnnnnnnnnnnnnnnnnnnnnnnnnnnnnnnnnnnnnnnnnnnnnnnnnnnnnnnnatttgcaaattcgccccgaatggattattgaaagccatttccattatgatgggggnnnnnnnnnnnnnnnnnnnnnnnnnnnnnnnnnnnnnnnnnnnnnnnnngtttttgctatgagtgatagcattgcgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagtgatagcattgcgattggtgcatatcaaatgattcaacgagcaggattacggattccgcaagatattgcgattatcggttacgataatatcgaacttgctcaatatctttatccccctctttctactattcatcaacctaaagcccgattagctaaagctgctgttgagaaattaattctacgtattcagcaaccacaaacggaaatagaaacgatcaagctaacccctgaattaatcatacgggaatctttttaaacttattttttgaagtagttcacattttcaaaataacatagttgtttttttattattttttgtctatcttttagtcatcgaaacgtttcgatggtttttaaaggacggtttgtgatgaaaaagacaacaatcttaaatgctcaactttcacatgtaattgcaacaatgggacataccgatggactcacaatttgtgatgctggtttaccaattccaacagagcagcattgcattgaccttgctttaaccaaaggtatccccgattttctttcagtcttacaagcggtatcaagtgaattatttattgaaaaaattgtattagctgaagaaatcaagaatattaatcctcaaattgaacaacagttattaatggttattcaacaaatagaggtgcaacaaaaaaataccattaagattgaatatatcccacataacgaatttaaacatcaaagtaatcaagccaaagccgtcgttagaacgggagaatgtagcccgtatgcaaatgttattctttattcgggcgtaccattttaggtggatatgatgaaaaacttactcaaaattagtggaatagataaagcctttcccggtattcaggctcttaaaaatgcttgcttgaatgtctatgcgggtagagcgatggcgttaatgggggaaaatggtgcgggtaaatccaccttaatgaaaattctcaccggaatttatcaacgtgatgccggtacgattgaatatctggggcaagcagtgaaatttgctaatccgaaagcctctcaagaagctggattgagtattattcaccaagagctaaatatactcggtaatctctccattgctgaaaacatctttttaggacgtgaatttacgcacccttggggcggtattgattggcgtaaaatgtatgcggaatccgaccgcttgttagctcgccttggtgttcgtcattccagtaaacttcctgctggtgagctttctatcggtgaacgacaaatggtagagattgctaaagcgttgagttttgaatcgaaagtgattgtgatggatgaaccaacggatgcgctgacggatacggaaacagaagctttatttgcggtgattcgtgagttgaaagcggaaggtcatggtattgtctatatttcccaccgcattaaagagattttccaaatttgtgatgatgtgactgttttgcgtgatggtcaattcattggagaaaaagcggttaccgatttaactgaagatcagttgattgaaatgatggtcggacgaaaattagaagaacaatatccgcatatcgacaccgatcaaggtagtgtatgccttgagatcaataatttgacgggaggcggcgtttatcaaatctcattcaacctgagaaaaggcgaaattatcggtgtttcaggattgatgggggctgggcgaactgagttgatgaaagtactttacggggcattgcctcgtacatcgggttcagtcagattagatggcaaagacattcataaccgtaccgcccaagatggattagataatggcatcgtgtatatttccgaagaccgcaagggggatggtttagtgctaggtatgtcggtgaaggaaaatatgtctttgaccgcattagcccatctttctcattacggaagaattgataaagctagagagaatatggtcgtcacggattttattgaactgtttaatattaaaacccccaatgccgataaaattattggtgagttatctggaggaaatcagcaaaaagtagcgatagccaaaggattaatgacccgtccaaatgtgctgattttagatgaaccaacaagaggcgtagatgttggagcaaaaaaagaaatctatcaacttatcaataaatttaaagcggaagggcttagtattattttagtatcgtccgatatgccagaagttttaggcatgtccgaccgtattttagtgatgcgagaaggtcgaatcagcggtgaatttagccgtcaagaagcgacgcaagagaaattattggcggctgcaatcggtaaaacaagcggtcagatctcataggaaatttgcaaatgaataaatcgtttaacttcactaaatttttaatcgaccaacggtcgatcattgcattaatcacgatgattgtcgtggtgtcatttctaaatccggatttttttactacggataacttgctcaacattctgcgccaaacctcggtgaacgccattattgcgattgggatgacttttgtgattttgattgccggtattgatttatcggttggttcagtacttgctttgacgggagctgtggctgcaaccttagtcggtatggatttaccggtttatgccgtgattcctacggtactgatttttggcggactgatcggcttgttgaacggatcgttggtggcattcggtaaagtacaagcctttatggcaaccttgattacgatgctgttattacgtggcgtgaccatgatttatatgggtggtcgcccgattagcaccggtttttccgagaatgctgatgctttcgccgaaatcggcacaggaatttggctcggtattccggttcctgtttggctgatgtttgccttatttgcgttaggttggtttgttctgacccagacgcgtatggggcgctatatttatgccttagggggcaacgaatcggcaaccgtactttcaggcattaatgtgaataaggtgaaactctttgtatttgcggtcagtggtgtattggctgcccttgctggtttgatcgtcacctctcgtttaggctccgcccaaccaaccgcaggaacaggctatgaattagatgcgatagcggctgtcgtagtgggtggtaccagtcttatgggcggtaaaggccgtattatcggcacgttaataggtgcattaattattggtttcttgagcaatgccttgaatttattagacattgactcttactatcaactggttgcgaaagcactggtaatcttagctgcggttatcttagataacttcattggtcgtaaaaaagtctagttgttctaagacattattcttcattacataggagatttttatgaaaaaattaacttcattagggattgcattaggtttagcattcagtacatcagcaatggcaaaggaaactatcgctctggcaatttcaaccttagataatccattctttgtgaccttgaaagaaggtgcagagaaaaaagccaaagaattaggctataacttagttgtgttggattcacaaaacgatccagctaaagagttgtctaacgtcgaggatgtgactgttcgtggtgcaaaagtgttattgatcaatccaacggattctgaagcagtaggcacagcagttgcggtagccaataagaaaaatattccagtcatcaccttagaccgtggtgcaaataaaggcaatgtagtaagccatattgcctccgataacgtagcaggtggaaaaatggctggtgattttatcgctgaaaaagttggtaaaaatgcaaaagtaattcaattagaaggcattgctggcacctctgctgcgcgtgaacgtggcgaaggttttaaacaagcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagaagccaaccaatttgaactacttgctagccagccagcagattttgaccgcactaaaggtttaaacgtgatggaaaacttacttgccagccacggttctgctaaagcggtatttgctcaaaatgatgagatggcattaggggcgttgcgtgcaattagagcttcaggcaaaaatattttagtcgttggttttgatggtacagatgatgcggtaaaagcagttaatggcggacaacttgcggcaactattgctcaacaacctgataaaataggagagttaggtgtagaagctgcggataaagtgttaaaaggtgaaaaagttgatgcacaaatcccagttccgttaaaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaactttgtgttctcggtagtatcaatgtcgatcacattattcgagtaccttacttccccaaagcaggtgaaaccttaacaggttacggttatcaaattgcttatggtggaaaaggggcaaatcaagcggttgcagcggcaagatgtggtgcaaatgtacactttattggtgcaattggtgatgatcaaattgggaaaacaatgaagcaagcctttgaacaagacgggatcaatacagaagcaatttctgttattgaaaaccaatcaacagggttagcgatgattcaggttgccgatttgggtgaaaacagtattgtgatttccgctggcgcaaatgcggatctttcagaggctttagttgaacaacataaatcacatattgaacaagcggatattttgctaatgcagttggaaagtccgttacaagcggtggctaaggctgcaaaaattgccaaaaaagcaggggtaaaagtggtgttaaatcccgctcccgctcaacctttaccggacagtttattatcacaaattgacattatcaccccaaatgaaacagaagcggaaatactgactggaattaaagtgaccaatgagcaaactgcagctgtagccgccaaccattttcatcaacttgggatcgaaacggtcttaattaccctaggctcaaaaggtttgttttatagcgaaaaaggacaaggtgaaattattccagggttccgtgtcgatgcagtggatacaacagccgcaggagatacatttaacggagcttttgtgacggcattattagaaggaaaatcacctaaagaatctattcgttttgctcatgcagcagcggcaatttcggtcacaagaatgggggcacagacagcaattcctagacgcgaggagattgaggcgctcttattattttcaatgtaacttaaactactatgttggagtttttcttaactggcagtttgtgaatgacaatgcggtttgatatttgtacttaacgagtcgagcggctacgatttgttaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttgttaggtataacgttaattttatctctctattgaaatacattgacgagcatttttaatcacaatatagtgtcgatagagaacaaagttgttttgcaaacaaagatattagaaaaaataatgaaggtcataaaaatttttattgatatttctttttcttatggtattttaaacagcgtctcagacacttttttatttgtagttattattttaagaggattagccaatgtcaaacaccaacgctattgcaaacgttgcaaaactcattcgagagaatgatattaaatttgtcttactgaaatttaccgacattaaaggtaaagaacacggggtatcaatgccagtttcccttgtcgcagacgacctcgaagacctttttgaagaggggagaatgttcgacggttcttcggttgaaggttggcgggcgattaacaaagccgatatgctgttaatgccaattcctgaaaccgccgttgtagaccctttcgcccgtatcccaaccctcactatccgctgcagtatcttcgacccaaacacaatgcaaagctatgaccgtgacccacgttcaattgctattcgtgctgaaaactatctaaaatcaacaggtattgctgacagcgtaatgtttggtccagagcctgagttcttcctctttgaggatgttcgttttagcactgagatgaacaatgtgtcttatcatattgatgatattgaagcggcgtggaacaccaaccgtaaatatgaagacggcaacaatgcgtatcgtccgctcaaaaaaggcggctactgtgtagtagcaccaatcgacaccgctcacgatattcgttctgaaatgtgcttaattttagaagagatgggcttagtgattgaagctcaccatcacgaagtggcgacagcaggtcaaaatgaaattgcaagccgtttcaatagcttaactttaaaagcagacgaaacccaaatctataaatatgtggttcaaaacgttgcccttgaacacggcaaaaccgcttgctttatgccaaaaccattcgcaggcgataacggctcaggtatgcactgtaatatgtcgttaagcaaagatggcaaaaacgtctttatgggcgataaatatgcaggcttgtctgaaactgccctttactatatcggcggtatcatcaaacacgctaaagcattaaatgcgtttactaacccaaccacaaactcatacaaacgtttagtaccgggttttgaagcacctgtattattagcttactctgcaagtaaccgctctgcgtctatccgtattcctgcagtaactagcccgaaagcaacccgtgttgaagcacgtttcccagatccaatggcaaacccatacttatgttttgcggcgttgttaatggctggtcttgatggtgtgattaacaaaatccacccaggcgatgcaatggataaaaacctctatgacttaccaccagaggagttaaaagagatccgagcagtgtcaagttcattaggtgaagcgttagataacttggaaaaagattatgaatttttaacccaaggcggtgtgttcactaaagagtttatcgatgcctttattgcaatgaaacgtaaagaagttgagcgtttgaatatgaccccacatcctgtggaatttgagatgtattacgcttagccttaaaagttaggttcagaaaataaaatagttgctgatgaatactttaattattcttagcaactatatttttatttaaagaatcctttataaatatagtgttatgtatcttattgtttttgcgtgatgaaataatttttcttcatttgcctaaataaatgttaaaaaacgatttagtgttttacatatcaagaatgtaatcatcaatagagtttttttgaacgctattagatagtcattcccaatctttattagagtaggataaatattagatttataaagtttgatattacttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcatactagctaatctaggtcagccccaaaaatattgctctcccaaccgcgcttcacgctcgccatttaccacaatgcaaatactcggctcttggtcgccatttacagaaacttggttagcgataaagttgttacttgtcgtggtctatatcgttttcggtgttgtggcacaaaaaaacattcgcaccccaaaagggttcgcgttttacagcttgtcgctactcgcttttttaacaatggtgttgctatcgctttgcaaaataggctaagacgtacaccgaacttattaaccaactgaaataaaaggaaataaaatgaagattttttacaaaacctgttgtcacagcccctggacaaagtgcggttacagttacgccaaattctgccacttcttcggcaatggcttggctgaaagacgtgacataggcttttgttgcataataaaccgcttgtaatggaccaggtaaaaagcctgccgttgaagaaacgtttagaattttaccacagcggcgttccaccataccttttaagtaaaaatggcttaactcggttaaagtggtgatgtttacttggatcatttgttgttctttggctaaatcacgctcaaaaaagcgaccgtgtccgccaaaacctgcattattgattagaatatcaacggtaatgccctgtgcttccgtctgtgcaaaaatcgcttgtgccgcattaggttctgataaatcttgggcgataacggtggctttaataccgtatgtgttagctaagtcgtgtgctagttcggccaatttctcttttgaacgtgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttgaacgtgccaccaacaccacatcgccgccttttttggcgtgaatttttgctagttccaaaccgataccatttgatgcacctgtaatcaatgctgtttgtttcattttttatccttcattgtctttgctttcgatgaagtgtattattccgtaaaataccagtatgaaaaaggtaaaaaagggcttaataatggcaaaaataggaaatacacaagcaatccccacaccgcaatcggcacttgaaatttgtctatttagtgaatttaaccaaagcaatttgcacgctgatgaattaacacgggaaatgctcgctgagcaacatcgctttgatttttatgtttggctgtgggtaacagaaggggaatgtcagcatttgcttgatttccaaagcgttacgcaacgcacaggcgaatggttgctgatccgcccacagcaagttcaccattttcaaacaatggaaggttgggacggttggggattatcttttccagccgaatgggtttctgctgatttagcctcaatttggcaacagctgccacaaaagcaatctgtaaccgccgagcaagcccctttgctgcaactggcgttacaacagctcaaacaatatcgctactttgaatggcaagggcaaaattatcagcccttattacaaacgcagttacacacctttctgaccttgctcaacaccctttatgctgcaaatcagccacaagaagaccaccaaaatcaacgttggcaaggtttttctcagctattggaacaacatttttgcacgcaacatcaagtccaattttatgcggaacaactcggttgcacagaaaaaaaacgctcggctcaacctgtttagcacatacggggctgcctgccaaaatggttatcaaccaacgtttgctacttgaagccaaacgcctactggtgcatacccaaaaatccgtgaaacacattgcgttacaactcggttttgaagaagctactcactttaataaattcttcaaaaaatacgaacgatgtacgccaaaaggctttcgggaaagctatttagcggaaaaataaaagagcggtggggttttcaggaaattttgcaaatacaaaacttatgaaaatcccacagctcttctacaagttctatgacaactgttttaaataatcttccaacccttgaacttccccatacaacaactggctcggcacaatatgcaaccgttgatcgttatcccacgcatagcgggcgaaatcggcgtccattttacgaccgctttggtaaaacagccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccgcaaaggggatcgaataaataataaattttcattaaaacattccacgtccgctttctgttttttctggtaccgcttggattacgtcccaatgttctacaattttgccgttttcatcgaaacggaaaatatccaccaccgcttcgcctttatctttttcattgagctggctgtgaacgtgtaatgctactaaatcgccgtccgctaatacacgtttaactgttgctcgcgaagttgggtgttctttcaaaaacggagcaaaagcatcaataaaggcttgaccaccatcggctacacttgggttgtgttgcaaatactctttgccgatatatttatccactgcgtcttgtaattgatgttggttaaacgccatttcatagaacgccaatgcattcgctttattttgctctggcgtagtttgtgccattgcaacggttgatgagaaaagtgcagttaaaagtaaaagtaattttttcattttgttttccttttgttggattatacattcagcttgattgctattgatggtgtgcattttaatgaaataaaaagagagaaaaagtgcgattttagaatataattatttccgattaagaaacaaaaaggataactatggacaaactcaccgcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcgttccacccgcaaagtcgccctaacagatgcaggcgaacaagcggtgcttttttgccaaagaattgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctggagagttttgaagggaaagcatggtagagttaaatttggttatttatttagcactcctgctttcccattacttatggtactgtttttacgtaattatcaacagtattccgaaaaataaatctttctataataatcattacaagaataataggtgatggaatttctaccattttttccccaagcggttgaaaatatgactgtattttcgctattttcacacataatatttggggctaatctatgatctgcccccaaaaagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaatatgggtgcttttcgattgttctaaaaagatttctcgttaaaactaaatagcgtagaatggtgtcatttatcactacatgccttgataatcatgaatccactaaattcgctacaattagctttaaaccaatctagccttattgaagcctctgcaggcacaggcaaaacctatacgatggcaaatttgtatttgcggttgattttaggtgttcggtgtccctccccattgacagttgaacaaatcttggttgtcacctttaccaaagccgcaacccaagagctacgagatcgaattagggaaaaattggtcaatgtgggaaaatggtttcgagatccctcttctaaagaggctcaagatgcgttacgagaaccattccttgcggcgctttatcaagaagttcaaccacgtttaaatgaatgcctcttacgcttaagcattgctgaacgcgaaattgatttagccagtattttcaccattgatagcttctgtcaaaagatgttgtttcagtttgcgtttagctctggcattcgttttgatattgatttattgagcaatgaagatgaattattaactcgtttgagtgaagaaacttggcgtgaactattttatccaatgggacttgcagaaactgtcgccgttgctgaagagttaaaaacgccttctgacgcattaaccgcagtgaaaggttatctctatggcgattttccagatttagcggcagaaaaccaatggctgacacaaggcatttcaagctatctcgccgattatcaagccttgttacaagaagctaaacaacattggcttgccgtgggggcggaagcggaaagcctgattgtgactgagatcaacaaaagctacaaaaaaggcgaaaagaaatcgctcagccgccgagcttatcaaatgcgttggattgaaaattggctgaaagagctgaacgaatgggctacaagcggtagccattattttccaaccaacagcctctctcgcttttgtcaggattttatcaatgaaaaagcggaagaaggggcagaaccgcttacccacactatttttgcaaaaaatcaagattatcttaccgcttaccaaacacagtttgaaggcaaatcaaaagcgattttcctctatcaattcttcagccatctacgtcaaaaacttgccgattataagcaaacccataaagagaaaagttttggcgacatgttgagctttttgctttccgctttgcaatcagagcgtggggatacgttagcccagcaaattagagccttgtatccctttgcgatgattgatgaatttcaagatacgaaccaacagcaatatgaagtgttccatcgtatctttatggatcaaaataccagcgagcaaggttttattatgattggcgatccaaaacagtcgatctataaattccgtggtgctgatattttcacctatttaaaagcgaagaacgaggttcaggaacaggcaacacttgaccgtaactggcgctctgtgcctgaagtggtggagagttgtaatcgtctatttcagtttccagaaggagataatcctccatttttatatcacggcattccctttcagcccgttaaagctaaagaggcttcagatacattagtgggtgaacaagcgacccgatgcctgttaatcagcacggagtttgatgaacagcttgcggccgctcactgtgcttatcaaattcaacaacagctgaaaaagagtgagcaagggttgctctttgtgcaaaaagaggagggaaatagaccgcttgaagccaaagacattacgatccttgtgcgtagccataaacaagccagtttaattcgtacagaattattaaaacgccatattccatcggtctttttctctgaacgaaacagcgtctatgaaacccaagaagcacaagatttacgctttattctttctgcgtgtttaaacccttaccgtcaatccagtttgctttcagccattggcacatcgctttggggcttaacatcgaccgacatttttaatatcaaacaagatgaaaaagcgtgggataatgtggtggaaaactttgtcggctatcaacaagtttggctacatcaggggattttaccgatgttgcaccaaatttttgtgaaagaaaatattatccaacggatcaatgctttgcctaatgcagaacgtcgcattactgacctgttgcatttagccgaattactacaaggggcaatgccaaatttagagaacgagttcgccttactacgttggtatgaacagcaattagctaatcccgatggctacgccgatgaacaaaaacagcgtttagagagcgaagaaagtttagtcaaagtggtgactatccacggttcaaaaggactggaataccctgtggtttggttgccgtttgtggctaaagcaagccaaccagccaaaagtaaatcaatggcaatctatcaaaatgatgaaggcaaggcttattggagtttcggctcacaatccgacgaaatcaaaaaatatattgataaagcagaatttgcggaagatttgcggttgctctatgttgcggtcacacgggcgaagtatcagctaaacctgattttaccaagtcaatttgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcattaaagcggagctgattacggttaataatgatgtgcctgaagacaattggcaaccaacactcgtgcaacctattgatattgaagcgaaatcctttacaggcaaaattcgcaccgttgggcaaattaccagcttcacggcattacaggctcaaaatgaacgtttgcaacataaagggcaaaacataccgcttgctacttttggtgacgaagctcaagattatgaccgcacagagttcatcgcctcggactttcttgaagataacgctcagccatatagtcgctaccaattcccacatagcacgaaagtcggtaatctgttgcataaattctttgagcattgggattttcaacaagcggtggatcaaacacaattacaggcattgtgtgaacaacttaatttagacgaagcgtggcttgagcctttaacaacgtggtttgagcaagttatccaaaccccatttggtgaacaagcggtcagtttaacgcagatttttacccataaacgcttgaacgaatggcaattttatttacgcctatccaataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacttaatcaactactgaaaaaacatagtccgttagccaaacagttgcctgatttgaccttatataacttagaaggctttgtgcgtggttttgtcgattgtattgctcaaattgacggcaaattctatgtgattgactataaatccaattttttaggctatttgccacaagattatcaagccgaaaaattagccaaaacaatggggcaattccgctatgatttgcaatatttgctctatacccttgccgttcaccgctacttaagcgctcgcttaggggaaaattataattacgagcaacactttggcggcgtggcttatttattcctacgaggaatgaatggcgagccaaatagtggtgtttattttgataaaccaagtcaggagttgattgaagagatggataggttgtttgggtaagagatattctctatatcaataaagcccactttgagtgttttgtgggacgaataaaaagaaaaatgatatttattgtttcggattaatgtaattactccccatattcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtctacgtaggcaaaaatacaatcctgtaaaagaagattatcctaagtaatttaaatatcatcacaacactcaataaagaatactttaattgaacaaaaagctgactctggctctaacccattatcagcccttaataattaaatagtgcaaaaatccacactctcaaatcggatacagcttacgattctttttctagcgttgtctgaattgccaactccgccaacgctttcgggttaccgaaacttggtgcatcggtcatcaagcaagctgccgccgttgttttcgggaaggcaatcacatcacggatattttctgtgccagtaattaacatcgttaaacggtctaaaccgaacgccaagcctgcgtgtggtggtgtaccaaattttaatgcgtctaacaagaagccgaatttctctttttgttcttcttcgttaatgcctaaaataccgaataccgtttgttgcatttttgggtcgaaaatacgcacagagccaccgcccacttcatagccgttaatcaccatatcgtaagcatttgctactgcaccttttggatcttgcacaagctcttcagggcttaaatcttttggtgcggtgaatgggtggtgcattgctgaccagttaccctcatcatctttttcaaacattgggaaatcgacaacccaaagcggtttccaagcggtgagatccgttaaacctaaatcacgtcctactttcaaacgtaacgcacccattgcatccgtaacgactttttcactgtccgcaccaaagaagataatatcgccattttgtgcattgacacgcgctaataatgctttaaccacatcatcagttaagaacttagcaatcgggctttgcaaaccttctaagcctgcgtttacatcattcacttttgcccacgctaagccttttgcaccatagttcccaacaaattgagtatattcatcaatctgtttacgggtaattcccgcaccattcggcacacgaatgaccgcaacacgcccttcaggatcgtttgctggaccactgaatactttaaattcaacatcttttagaatatccgccacatcaactaattctaacgggttacgcagatcaggtttgtctgaaccaaaacggcgcattgcttctgcaaaggtcatttgtgggaactcacctaaatcgacatttaagcgatctaaccacaagccacggatcattttttccatcattgcacgtacttcaggggcggtcataaaggtggtttccacatcgatttgggtaaattcaggctgacgatctgcacgcaaatcttcatcacggaaacatttggcgatttggtaatagcggtcaaaacctgacatcatgagcaactgtttaaataattgcggtgattgcggtaacgcatagaatttgcctttatgcacacggcttggcactaaatagtcacgcgcaccttgaggagttgctttggtgagcattggagtttcaatgtccagaaaaccattgtcgtccatatagcgacgcacaaaactggtaatttttgcacgggttttcaaacgttccgccatttcaggacggcgtaaatctaagtaacgatattttaaacgctgttcttcggtgttgttctgattgaaatcgagcggtagcacttctgagttgttatacaccacaagttctttgaccaacacttcaatttcacctgttgccatctctttattaatttgagatgtatcacgagcaatcacttcacctttaatttgcacgcaggcttccgcacgcaatgcaaaggcttgtttgaataaggcttcatctttctcatcaaagaaaacctgcacgatcccttcacggtcacgaatttgcataaaaataaaacgaccaaggttacgcacacggtgtacccaaccgcttaatgttacttgctcaccaacgtgagtacggtttaacacaccacaataatgagaacgcatcatatctagttatccttcttataaaatttggaaaaaattgtggcgattatagcgaaaacagaccaaagaaaacagataacaatggaaaataatcatttaagccttgaaatcccgtaatttgtcgctatattagcggtcgttttagtgcaaaaatttgcgaagtcaaaatttgaggatacacaatgacaaaccaaactgaaaaagaacaagtagaacaagacgttagccaagtaactgaattagcacaagaggctcaggaagctcaaacacaaaacgttgaacctgagttgcaacaaaatgatgaaatcgatccgcttgaagaagcgattgctcgtgtacaagagctagaagcctatattgctgaagcggataaacgtgaacaagatattcaactgcgtgcaagagcggaagtcgaaaatatccgtcgtcgtgcagaacaagatgtagaaaaagcccataaatttgccttagaaaaattctctaaagagatgctgactgtcgttgataacctagagcgtggtttgcaggctcttgaaggggtagatgaaagcgtaaaatcaggcatagaattaacccataaaggcttagtttcaaccttaaataattttggtattgaagcagtcggcgtggtgggtgaagtatttaacccagagctacaccaagcaatttcaatgcaaccagctgagggcattgaagccaaccatattagtgtagtcttacaaaaaggttatacgctacacggacgtgttatccgtccagcaatggtaatggtcgctagttaattttctgtttttcgacggcgatcacaaaattagccccaaatacctgcgtgatttatgttattttttgataacactaatcacaaagggaataaaaaaatggacgcaactatgagtattcgatttgataaacttcgctttgtaaaaaagctacaagaagctaatcaaccacctgaggttgcagaggcgtttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgggactaatgcgatttatcaactaaccaaagaaaaacacaatcccttatttgtttatcaagtaagggattttcatcttaaataaacctatgtcactacaatttaattctgttgccctactgcttgttgcacttatcttacttggcattttcagccaaaatagtgctgtaaccatttccgctgccgtcctattgattatgcagcaaacattattggcaaaatatgtgccttatctcgatcaatacggtatcaaaatcggcattatcattctgactatcggcgtacttgcccctcttgtatcagggcgaattgccttgcctgaacttgttcaaccgattaattggaaaatgatcgttgctattattgctggcatagtagttgcttggcttggcggacgtggcgtaaccctaatgggcaaccaacctgtgctagtcacagggttattaatcggcactattatcggtgttgctttcttaaaaggcgtacctgttggtccgttaattgctgctgggattttgtcgctcatcataggaaaatcgtaatttaccattgaaatatgcaaaaaaaccataaaaaccaaccgcttacagcagaacaaaaaaacttacttaaccaactccaagataccactttaattgatgctcgccgtttagccaggcgtattcgtgggttggcgaatatcaaaaatgaaaacgctaaacaagccatcattgcagaaattgaggtggatttgaccgcttgtaaaagtcgctatctcacgcgtaaacaacaagccgaacaactgaaaattgagtaccctgatctgcctgtttccgctcgccgtgacgagatcttaaaactgattgccgaacatcaagtggtggtgattgctggggaaacggggtcgggtaaaactacgcagttgccaaaaatgtgtttggaactagggcgtggggtgaaaggactaatcgggcatacgcaacctagacgtatcgcggctcgctcggtggcgacacgcattgcagaagaattgaagtcagaacttggttcaaccatcggttataaaatccgctttaacgatcagattagcgataacaccctcgtcaaattgatgacggacggtattctgcttgccgaaatccaaaacgaccgctatctcaatcaatacgatacgctaattattgacgaagcccacgaacgttcgcttaacaatgattttattcttggctatctcaaacaaattttagcaaaacgccctgatttgaaggtgatcatcacatcggcaaccattgacgtggaacgtttttctaaacattttaacaatgcaccgatcatcgaagtgtcgggcagaacttatcctgtggaagtgcgttatcgcccgattgtggaagaagatgatcaagaccaactgcaaggcattctcaatgcggtggacgaactgcaagcagaaggtcggggcgatattttgatttttatgaacggcgagcgagaaattcgtgatactgccgaagccttgcagaagcaggaacttcgccatacggaaattttaccgttatatgcccgtttatctgccgcagaacagcaacgcatttttaatccaagtaatctaaaccgcattattctcgcgactaacgtggcggaaacctcgctgactatcccaaatatcaaatatgtgattgatacaggaacggctcgcatttcccgttatagctatcgtaccaaagttcagcgtttgccgattgagccgatttctcaagcctccgccaaccagcgtaaagggcgttgcgggcgtatttcggaagggatatgtatccgcttgtattcggaagaggattttaacgcccgtccgcagtttaccgatcctgaaattttgcggacaaatttggcttcggttatcttgcagatgacggcgttgggtttgacggatattgcttcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatatcggtcgccaactcgcccaactgcctatcgatccccgtctgggtcgtatggtgatcgaagcggctaaaaacggcagtttgcacgaagtgatgatgatcgtatcggcgttgtctattcaagatcctcgtgagcgtccgcaggaaaaacagcaatcgtcagatgataaacatcgccgttttgccgacaaagagagcgattttttagcctttgtgaacctgtggcattttattcaagagcaacaaaaggaactcaccaaaaatcagttccgcaagctctgccaaaaagattatctcaactatttgcgagtgcgtgagtggcaggatatttatcatcagcttcgccttgcggtgcgtgaaatgggcttgccgattaacagtgagcctgcaaattatcagcaaattcacaccgctttattatcgggcttattgtctcatatcggcttgaaagataacgaaaaaatgcactatttaggggcgagaaatgcccatttctacctgttccctaattctgtgcttttcaaaaaacagccgaaatgggtaatggcggcagaattggttgaaaccactaaattgtgggggcgaatggtggctcggattgagcctgaatgggttgaaccgcttgccaaacacttaaccaaatccagttacagcgaaccacgttgggcgaaatcaaaaggggcggtggttgccgatgaaaaagtctcgctctacggtattccgattatcgccagccgtcctgtgatgtatggagcaatcgatcctgttgtcagccgtgaaatttttatccgctcagcgttggtggaaggtgaatggcacaataattacaaatttttcaaagaaaataaccgcttgatcaaagagatcgaagagttggaacataaatctcgccgtcgagatattttagtggacgagcaagtgctgtttgaattttacgatcagcggatcggcacagatgtcgtttccagcaagcattttgacagctggtggaaaaaagcgtcacagaaagatcctgaactactgaactttgaaaaatcgttcttgatgaatgataatgcaaacaaagtcagcgaattagacttcccaaatttctggtatcaagattcgctcaagttgaagctgagctatcaatttgaaatcggctcgcaagcggacggcgtgacggtacatattccgttgccgttgctgaaccaagtggatacgcacggcttcgattggcacgttccagggctacgtcaagagctaatcattgccttgattaaatcgctaccgaaagccactcgccgtagttttgtacctgcaccaaactatgcagaagcctttttatctcgtgcagagccgtttaaaaagccgttgttggaaagtttgagttatgaacttcgccgaatgacaggggttttggttgagcctgaacagtgggatttaagccaactgccaccgcatttgcggatcagcttccgtgtgattgatgaaaaaggcaaaagcattgctgaaagtgaaaatcttgatgagctgaaatttaacttgaaagacgaagtgcaaaataccctgtctaacattgccgatgacggcattgagcaaagcggtgtgcatttgtggaattttgcagatttgccacaattttacgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattttagcgtaaaagcctaccctgcgattgtcgatgaaaaagatgccgttgggatcaagctgtttgaaacggaatttgagcaagccaaagcaatgcaagcaggcttacgccgattgttattgctaaacgtgccgtcaccgattaaatatctgcacgaaaaactgccgaataaagctaaactcggtttatattttgctccgttcggcaaggtgttagagctaattgacgactgtatcgcctgtgcggtggataaattgatggaagagtttggaggctttgtctggtcggaagaaaaatttaacgcccttcacgactacgttagagcgaatttaaacgataccacggtcgagattgccaaacaggttgagaaaaatctcacccttgcctatgaaatcaacaaacgcctaaaaggtaagctggatttcacaatggcatttgccctgtcagacattaaagcccaaatcgacggtttgatttaccctgattttgtcaccaaaacaggttacaaacgccttgcagatttacaccgctatctcaccgctatcgacaagcggttagataagttggtggtggatagcaatgctgaccgatccaaaatgttgcgagtggaacaggtgcaaaacgcctatcaacaactgttggcgaaactgccaaaatccaaaccgatttccgatgaagtcttagaaattcgttatatgattgaagagttgcgtgtcagcctgtttgcccaacagcttggcaccaaatatccgatttcggataagcggattttgaatagtattcaccaaataataaaattttgaaaaaacacttaaatttgtaaaattatgtaaacaaacttgtctacctttatgataattattatcatctagccacttccaaaaataataggtaatcactccaactcttacgcctcattcccccacaaaatgaggcgtttttttcgccttttttcttcgttctccgctataatagccagtatttttcgcatatagtaaaaggaataataatgacacaatctattgaaaccgttctcgctgaacttaaacgtggcatagaagatgtttattcagaagcagatttaattgagaaattaaaagaaaatcgtccgttacgcgtaaaacttggagcagatccaaccgctccagatattcacttagggcatacagtcgtgttaaataaacttcgccaattccaaaattttggtcacgaagtgattttcttaatcggtgacttcactgcaacagtcggcgatccgtcaggtaaaaatgcaactcgtccgccactttctcgtgaagatgtattacgcaatgcggaaacctataaagagcagatctataaaattttagatccacaaaaaacccgtattgtgtttaactctgagtggttaggtgagttaggcactattggtatgatccgcctagcatcaaactatactgtggctcgaatgctagagcgtgatgatttcaaaaaacgttttaacaataatcaatctatcgctattcacgaatttatctacccattattgcaaggtcacgactctgtggcattagaagcagatattgagcttggcggtacggaccaaacctttaacttattaatcggtcgtgagttacaaaaagcagcaggacagaagccacaggttgcaatgacattaccacttctcgttggtttagacggcgagaaaaaaatgtcgaaatcccttggtaactatatcggcgtgaccgaagcaccaaatgaaatgttcggcaaaattatgtcgatttctgatgaactgatgtgggattggtacaatttactttcattccgtccattaaccgaaatcgcacagttaaaagctgatgtggaagcaggtaaaaatccgcgtgatgtgaaaattctattggctaaagagattatcgctcgtttccattctgaagcagatgcagatgcggcagaacaagagtttatcaaccgcttccaaaagggggcaatgccagatgaaatgcctgaatttacctttgaaggcgaaatcggtttagcgacattattaaaagaagcaggcttagtgccttcaacatcagaagcaatccgctctgcacaacaaggcggtgtaaaaattgatggcgaaaaagtcgatgatgtgaaacaaaacgcacagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggactttcgtttatcaagttggtaaacgtaagtttgcgagagtgactgttaactaatcctcaaaatcgtactacctaaagtctttattgcaaactattcaattcagcagaagagcttagtttaaattcaaactaagctctttatgttatatagcattactctctttatattcaataattactctaggtgttaattttgtaataagttcataattgatgacaccaatagcttccgcaacttcttcaattaaaagtttatccccccaaagctcaacttcgtcacccactttatcctgactatcaacaccaagatcaacggtcatcatatccatcgaaacacgtccaacaataggaaccttacgcccattaacaaaaacaggcgtaccttcaggggcatttcgaggataacctacccaaaccgccatagcccacaggctcaccagctttgtggctgcgaaccgcaattagagaagaagataatgtcattacgggtttaaatcctaaatcaataattggcgttgtgtgcggagaaatgccgtacataataatgccagggcgaacccaatcataatgggcttgcttccaataaagaataccgcttgaagcagaaatactacgctcaaccttgtactcttgactgactgtttcaaaagtagcgatctgcttttcggtataatcacaatcaagctcatccgctcgactaaaatggctgacaaagtgaatacattctacgagaggacaagcggttaaacgttgataaaattctgcaacttgttcggggtgaatacctaaacgatgcatacctgtatcaatcttaagccaaacggtaatcgggaaataaattttggttttacgttgccaaaagcctttctgtttttccgcttgccactcttgagccacattttcgagcagctcaagttgctcaaggcaatgaataactgtatcgaaacgacgggaaagggtttttaataattcttcacgatcaaaaaaaccttcaagcaataaaattttaccggcatagccactttcttgaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcaatgcttctttaatgcgagcaacaccaaaagcctctacctgatcttctaaattcttaatcacggctcgaataccttgcccgtaagcattggctttgactaccgcacagattttactgtgaggagccaaagatttaattaaacgcatattatgtcgtaaggcactaccgttgatcgtcgctgttgctggtttcatcgttttaaagtatctatttgaaaatactcaaaattatacgctgaaattgtaaaaatccctagaaattcaggaaaaatagactaatatataggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactaatatataggcaattgtttaacctatattaaggagaatatgatgttatctgaattgatgattttacccttcgtctttgtcattttgaccattgccattttactatcgtcaattaaaaccgtgccgcagggatttcattggactattgaacgttttgggcgttataccaaaacattaaccccagggttgaatattgttattccttttattgatagggttggacgtaaaatcaatatgatggaacaagtgctagatattccatcacaagaagtaatttccaaagataatgcgagtgtggcaattgatgccgtttgctttgttcaggtgatcgatgctcgtcgtgctgcttatgaagttaatcatttagagcaggcaatcatcaatttaacgatgaccaatatgcgtacggtactcggttctatggatttagatgatatgctttcacagcgagatttgattaacggtagattattagccattgtcgatgaagccgcaaacatttggggtgtcaaagtgacgcgtattgaaattagagatgtgcgtccgcccaaagagctagttgaagcaatgaatgcacaaatgaaagcggagcgtaataaacgtgccgatattttagaagcagaagggatccgtcaagcagaaattttgcgtgcagaaggggaaaaacaagctcgcattctaaaagcagaaggtgaacgacaagaggcattcttacaagcagaggctcgtgaacgtgcggcagaagcggaagcaaaagcaacacaaatggtgtctgaagcgattacaagcggtgacactaaagcaattaattactttattgcacaaaaatacactgaagcactgcgtgaaattggtgctgccagcaatagtaaagttgttttaatgccgctagaggcaggtaatttaatcggatcagtggctggcattgctgaattacttaaaggcgataagaaataagggggaaatatggaatggctttcgggctggactgcttggctgatttttggttttattttgcttattctagaaactctcattgcagggatctttataatgtggtggggatttgcagcgattattgttgcaatactactcatattattccctaatatcgaattgggctggcaagccactatttttgcggtcttagccattctatttagcctcgcttggtggaaatatcagcacagtaaagatcagcaagaagatcaacaagccgatttaaatgcccgagatcacgcaatgatcggcttacaggggactgtcgttgaagttctcgacagcggtgttgcaagaggtaaatttggtgacacgacttggcgagtaattggcaacacactgaaagttggcgataacattcaagtagaaaaggttgatggcattaccttgtttgttcgtgttgtnnnnnnnnattctgacaataaaaaaccgcttgttttacaaaacaagcggtttgatttttctaaattttaccaatgaatttattctgttttttcagttttctcttttggtaatactaaatttaagataattgccacaaccgcacataagctgatgcctttgagtgagaactcgcccacgttaatcaacattccaccgataccgaatgtcattaccacagacacaatacagagattgcgtgcttcgctcatatctactttagcgcgaattaaggtactcatacctactgcagcaatagagccgaacactaacatcataataccgcccatcacgacaccaggaatagtttgtaacaatgcaccgacttttccgcagaaagagattgcaatagcccaacatgccgcccaagtcatcacttttggattgaagtttttggtgagcattaccgccccagttacttccgcataggttgtatttggtgggccgcctagcattgcagcagcagatgttgccacgccatcacctaaaagtgtacggtgtaaacctggtttgcttaggaagtttttccctgtaacagagctaatcgccataataccaccaacgtgttctactgctggtgcaagtgcgattggaagtaagtagaggattgcttcaagtttaaattcaggtgttgttaattttggcaagctgaaccacgccgcatcataaacaggttggaaattcactaaaccgaagaagagtgacacaatatagccgaccacaattgcgaacataatcggcacaagtttcatcatacctttggtaaatacagccacaattagtgtggtaattagggtaatcattgaaacagtaactgccgttgcataaggaatatcagtgcctttaccgatagccatatctacaccgacgggtgctaagcctaaaccgataatgatgattactggaccaactacaacaggtggaaataacttatctaaaattgccacacctttaaatttaactaatgcggaaaggacaaaataaattaaaccagagaaaacaattccccccattgtgacagggattccccactgctgaacgccatattgaatgggtgcaataaacgcaaaagaagaagcaaggaaaataggaacttgtcctttagtgcagatttggaagattaaagtaccgataccggcagtaagaagtgctgtgttaggatctaagcctgtaatcaatggcattagaaccaatgctccaaatgcaacgaaaagcatttgtaagccaacgaacgcctgtttaggcgtactgatattttctgttgtcatttttcaactctctaataatgtttgatagtcgccaagctacaagacatagctcaggcggacattatatagaaaaatgcaaacgtttgcagatttttttgtcaaaaaaattaattagataggcaaattttgtaaaggcagaaagtgatattgcatagagataatgtgagcacacaacgtgtgcccacaggacgaaattatccaacccaaacaaatttagcaataaagagcagtgaaaccaccgcaacagcagggttaatctcttttactcgacctgtacagagcttcataatgcaatagctaatgaaaccaaaggcaatcccttcagtaattgaataggtaaatggcatcatcgctgtagtaataaatgcaggtgtcgcttcggttaagtcgtcccattttacttcaattaaacttgaagccattaaaatgccgacaaacactaaagcaccagccgttgcataagtaggcacaacagctgcaagcggtgaaaagaagatcgttaataggaaaagcacgcccaccacgacagcagttaaacctgtgcgtccaccaacagaaaccccagaaccactttcaatataggtactgatcgctgatgttcccatataagaacccgccatagcgctgacgctatcgacataaagtgcctgtttcatttttgggaagcgaccttgttcatcggcaattccagctttattcgtaaccgcaattaatgttcctgatgagtcaaacaagttaaccaacataaaggaaaagataatccccagcaatgcggtatctaatgcccctgcgatatcgacttgtccaacaacagcttcaaggcttggtggtattgaaatcacgcctgagaatttgacatcaggatcaaagattaacgctaatgccgtcacaacaacgattgaaattaatacgccagaatgaataccttttgcagccagtaccacgataataaagaagcctaaaatacccattaagacttttggatcgtgcaattcacctaacgccactaaggtcgcagggtttgcgacaacaagccccatatttttaaagccgattaacgcaataaataagccgatacctgcaccaatacccacacgtaaaccaagtggaatggctgacataaaccagtagcgaacttgtaatatcgtgagaataaatagaccgacagaaccccagaagattgcccccattcctgtctgccacgtatagccgagtttttgaacgacgacaaatgcaaaaaaggcattcaatcccattgcaggggcaagagcgatcggcaagttactaaataaacccatcgcaatagtaccaaaagcggcgattaagcaggtggtaacaaagacaacttgggtatccataccagccacacctaaaatagatgggttgacgaaaacgatataaaccatcgtaaagaatgtggtgatccctgccacaatttcagttttgacattactgcctttttcttttaattgaaacaaacgttcgagcatagtgcctcttaatagaataaagaatttcaggaaataagatggaaatgaaatcgacgaaggcaaccgacagtactaaatgcacaaagagataggaagtcttggctatttcgttcagagtgtagccaaaatcttaggattactcaagggatagaatgtaaaatacgtaatcgtttgcttatttaagcattattctacaaaataatgtggtacaaagtggctatcattccctgtaattgcggtaaaatcttctcgaatacctataccacaagcagtatccccaacaatccaagagcctataactggatacattccatcaaagcaagggattgcatatttttgttgaaatacatagggggctgtcctagataatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagcataaacaaaataaactcattgagctgtttgtggcaggtgtcactgctcgaacagcggctgaattggtaaatgtaaataaaacgacagcagcctattacttctatcgtctgcgattgcttatctatcaaaacagcccacatatggagatgtttgaaggtgaaattgaagccgatgaaagctatttttgcggcactcgcaaaggtaaacgagatcgtggagctgtgggtaaaaccgctgtattcgggcttttaaagcgtgatggtaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtataccgtcgttatcatttttcaactctctataattgaactaggatttatgtaccatgagtgatgaaaaactttgtgatacaggcatgatttcaatgctatttacattcacatgattaggttgttgattcagccacaatactatttctgcaatatcttcgggttttaaatactctacattttcataaagtttagataccttttccttatcacctttaaagcggacgtacgaaaactcagtatcaccacataaccccggttcgacattactcacacgtattgctgtcccaattagatccgctcttaaatttaaactaaattgtttcaaaaaagccttcgtccccccataaacgttacctcctggataagcatatgtgccagctattgatcccaaattaataatatgcccagtatttctttctaccattcctggtaaaatcaaatgggtgatagtaaccacccctttgatattggtatcaatcatttggtaccaatcatctaaatctgcttcatatgcagcatctaaacctaatgccaaaccagcattattcactaataaatcgacatgtttccaacaatctggtcgattatttagagcatgaatcgtttcatctgcattacgaatatcaaaagcaagcggaaaaaaatgatctgggaattcatcttctaacatctttaaccgttcaatgcgtctccctgtaccaataactctataacctgcctgaatcaacgttcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaccgaatccagaagttactcctgttaccaatgctgttttcataattcccctccctaaataccataggtaaaaaaatattgaaggataaaaattgactatgagttattgtcaccctctctcaatagttttgcgattgcattacgataagtgatctctaagctctctcgacttgtcgccataacaccttgatcatttaagaacccatcattaacatcatagacccaaccatgaatagagagttttttccctctctcccaagctgatttaacaatagttgaacgtcccaaattataaacctgttccgctacattcaaacgaactaacatatcccccctatgttcgggagatatttttccaagaagatggctatgtttaaaccatagatctcgaatatgcagtagccaattgctaattaaaccatgatcttccattccaattgcagccttaataccgccacagttggtatgtccacaaataataatatgttcgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataataatatgttcgatatccagcacatccacagcatattgtacaactgaaagacaatttaaatcggtgtgaatgacaagattccccacatttctatgaacgaatagttctcctggctctaatcccgtcaacttctcagcaggaactcgactatctgaacatccaatccataaaaaactaggtttctggtgttctgctagctgtttaaaataatctgaatgctcatctttcatttgagttgcccaagcatgattatttgcaaacagacgttcaatttttttcataaattcccatttagtataaaaaacaaaccccaaattttaaattgggaaagaacaattcttattcaaagattaatgaataaaaaggttttcatcttattatgagtactcatatccgtcaaatttaatcaataattaaactcaacgagcagagagatccccataaatggatagaacattatatagtaagttttatccctccaataaatccaatatgctatagcaaaatagcggggaagctcctacaagtctaatctgatcacataagtatgattgaattttactgctttcatgtagcatctaccacgttttttgtttaagatgaaacacaataatttctttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcttcgctgtgaaaatatcagcaaattttaccaagagggcgaaaatgctactcaggtgcttaaaaacgtatccttttcaatgaatgcaggcgaacttgtggcgattgttggtagctctggctcaggcaaaagtaccttgttacacactcttggcggtttagatcaacctagtgacggcgaggtgtttatcaaagggcaatcattgcaaaagctcagtagcaatgcccttgcaaaactacgcaatcaacatctaggctttgtctatcaatttcatcacttaatggcggatttttctgcgttggaaaatgtgatgatgccaatgttaatcggacaacaaaataaaacggaagccaaagatcgtgccgaaaagatgttacaagcggkcggtgaacgccagcgtgtcgcgattgctcgtgcgttggtgaataaccctgcgttagtccttgctgatgaaccgaccggtaatctcgaccaaaaaacaaccgagagtatttttgagctaattcagcgtttaaatcaagaacagcagattgctttcctgttagtgacccacgacttgaatttagctcacaaactgaaccgccgtttaattatgcaagacggtgtattgcgtgagggtaactgatgaataccccattttttatcagttggcgttatcagcgtggcaaacagaaaaatcgcttggtgtcgttgatttcgctcttttcgagtgtcggcattgcgttgggcgttgcggtgctgattatcggcttaagtgcgatgaacggctttgaacgagagctaaatcaacgagtgctttccgttgttccccacgctgaaattatggcgtataacgaaagcaaatctgcgaccattgtacaaggtgatcgccttgaaaatattgtaaaagatacccctaatgtgaccgctttatcgccgtttgtcagctttaccggcttaattgaaaacggtagtcagctaaaaattgcacaggttcgtgggatagatccaaccaaacaagaacaagtgagccggctcgcccaatttattccgcaagatcaatggcaagcgttcaaacaagaaggcggtttaattttaggggctggaattgctcgttctttggatattaatgtcggcgatgaagtcaccctgttattgccacagccaaccgacgacggcaaattggctcaacctttacgttttagcctaacggtaacaggtattttgcgtttagacggacagcttgatcacagttatgctctgcttccgattgcgaaagcccaagagctgttagaactgaaaccaagccaatatacaggcattgaattagcggtgaaacagccgtttcaagtcagagagattactttccctgaattatcgaattacccacagcaactatatatgcaaacgtggattgataaatttggctatatgtacaacgatattcaactgatccgcacggtgatgtacattgcgatggtgcttgtgattggtgtggcgtgctttaacattatttccaccttagtaatggcggtcaaagacaaacagggcgatattgccattcagcgaaccttaggggcaaacaaccgctttattcagcacattttcctttggtacggtttgatttcaggtatgaaaggggcgttattcggcgtggtgttaggtgtggttgtatcaatgaatttaactgcgattattaaatggtttgaaagtgtaatcggaatgaaattgctctcagacggggtctattttattgacttcttaccgagcgaaattcattggctagacattgtttgggtacttctcgccaccctaattttaagcctaattgcaagcctttatcctgcaattagagcgtctaaattagaaccagcgaaggtgttgagtgggtattaaatacttttagagtatgactatttagaacggaagttatatcaatcccaacaccttccgcccattcacacttgctatgttcgccatctcttcgaggttggtaaaacggcagccggcggaaagtaggctaagttcttgccacatatccccctcacaaagaggaaccatatagtcacagatattatctgtaccaattgctacagtaattccctctgggatcatctcatcagcaggcgttaaagcattatggaatggtaaaacttcatctttacgaggactatcaatccacgccatcgggcaagcaatcatcatcatatcaacggctttcattttcttataaagcatctgacgatactctctcgggtgagcaccgattgaaatcccgtgaatagccaccacacgcccttgcattccgtgttccaccgctttatcacacagttgctctgtttctttctctttaggattgttaaattgatcgacgtgaacgtgcagcattttaccttgtgattttgcggtatccattaaaatatccatcgcttctaagccttttccgtagtccaattcatcacgataaggtaaaccgccaatcatatctaccatttctgaaccaatatcaaaccacttgcgagcattaggttcgattacaccttttaaagtttgatttgcaaaacgtagaataatatcgtttttatacacttcgcgtgctttatgtgctgccaaaatcgcacggtcttcgcagacttggtcaatatcaacgaaagtcccaaatgcagttaccccttgtgaaatcatcaactcaatcgcttggctaaaacggcggtaataatcttctacgcttgaatttcgtttgacttcatcaactaaatcccatttctgttgtaaattggcattttgataaattttgattttctcaggtgtcatagtgaatgctctatctgcgtgcgcgtgggaattaacccagcccccttttttaatcacttcatcacgaatatggctttttaaagtacgaattaactggctcattgcttatcctctaaaatatgggcaaaaaaaaatctcaaaaatgagatcttctagaaatggaaaaataatgcgataaaaaaacagccaagcttcgttgaatagcgaagctcagctgaaaaagtgtgttggatactgttatatgatttggttgcatttctagttcctttcttggcactaggactacattttatcttgtttttcttctcaatgcaaacgtttgctttaaataaagtatcaaattttaagcggtcggttctcttaataatttttcaattactcgagaaacggcaaaaaagccaaaagtggcagtaaccatagtcgctgcaccaaaaccattggcacaattcattgttgcagacacttcacagccctcgctcattttagggaaaatcaatggctgagtagagaatacacaatcaataccaaatttacgtttagggttttggctgaaattatactcttttcgcaataggctacgcaccttagacgctagaggatcttgaatagttttacttaaatccgtgatctgaatttgcgttggatcagtttgcccacctgcaccgcctgtggtgattatcttgattttattacgcttacaaaatgcaattaacgctgctttcaccctaacgctatcaatcgcatcaatcacataatcataatctcttaacaaataatcagttaaattatccagtgtaagaaaatcatcaatgatcgtcacttcacattcagaattgattttagcgatccgctcttccatcacttccgttttcaatttaccgatctcgcccgacattgcgtggatttggcgattaatgttggtgacacaaatatcgtccatatcaattaaggttaatttaccaatacctgaacgagccaacgcttccaccgcccaagatccgacaccgccaatcccaatcacacaaatgtgcgattgatgtaatttggctaatccttcagctgtataaagacgaccaattccgccaaaacgttgttcgtagttgtctattcttgccatgttaatcctttagctctacataaactacttcgaatttgttgagggttaatgcaacttcatcgttggtcttaaaaaacgattaattctaccaaccaacataatcaaccctgttttgacacaaccgtgtagagccacttggtgcatacgatagagtgaaaggtatgccatacgggcgatcttcccttcaataaacattgagcctttagttaaattccccattagactacctactgtaccaaaacgagagaaagaaattagcgaacctttatcatcaaatataaaagcctttaaaggtttgttttctaactgtgctaagatatttttaccacaaaacgttgccatttgatgtgcagcttgcgctcttggcggaacaggcttaccatctgcttgtagcaaaaaggcacagtcaccaatcacatagacgttctcatcagttaatgtctgtaaagtatctttgattgcaatttggttaatacgattagtttcaaagccaaatgtttttgttatttcaggggctttaacacctgccgcccaaaccatcagatctgctttaaagttttcatcatatttagtaactaatccctccgcagttgcacgaataacaggagtattggttaacacatctacacccaatgcacgtaactctttaattgcagatgccgataccctttctggtaacgcaggcaacaagcgttctcctgcttctaataatgttaccttcaagctagtattatctaacttaccatatccataagaatttaaatgtttaaccgcattatacagttctgcggataactcaatacctgtagccccgccaccaacaacagcgatatgaacttctttttcattattatttgaaaatttcaaaaacaattccatcatacgtttatggaatacttttgcttgctctgaactgtctaagaaaatacagtgttctgcaacaccaggcgtattaaaatcatttgagcgacttccgattgcaagaaccaatttatcatagacaatggtacgttccgctactaataattcccccgcctcatcatagattggggctaatacaatgattttttctgctggtttaacttgagttaatgtgccttgacgaaattcaaagtgatgatttttcgcatgggcacgataacttaaagcatcagtaccatcatctaaagagcctgttgcaacttcatgaagtaacggtttccataaatggctaatatttttatccaccaaaataatatttgcctttttctttttacctaatttgttacctaaataagttgcaagctctaatccacctgcaccgccgccaacgataacgatcgtttccattgtttgctccgaaatgaataaatattaaaactaaaggcattctaaaccttagctactgaatgatctaggtagatttacaaattatttcagtggaataaataaatagatatttgataagttttgcacaggcaaatgatgtcaagtcaaaaaaggtgaaaaaatcttgatttttttacattttgcctctagtcaaaatgtaacatattgattttaaaagaaaagttattttatgtacaatcgtaaacccgcatcaaaaaccctatgaattatcaagggtttggcgtgttttaaaaaagtaatccacaaagttatccacaggctttgtggatagaaaaagccttattttttcactgattttatgaacagtaatgaggggcgatgttgaagatctttaaattcattgtgccattcaacttgatcggcaagcataggctcttccacttgctcaatggtgaaattgctttgaataagggtatttaaaatagtggcggtagtgcggtggtaagttttaaaagattgctgaaaccaattacgatcacgctcaccttcatcacggtaataatttaggcggtatgcgacttgttgcttattgattttttcccaacgctcaccttctttaaaacaagttacaatcgggtgttcttgcgaaaaaatcagttgcccttgtggttttaatttggcagaaatctgcgttaataaggcagataaatcttttatataatgaaaagcaaaagagcttgtcaccagatcaaaatcgctttctgctatggtggataagacttccatcggtaagcaataaaagcggtaagcggtcggatcaaccccgttttttgcaaaatctttttcagcttgttcaagcatagattgagataaatctaagcctacaacctgtttcgcccccattgccatataatgcaacaaatgcccaccagccccgcaacctaaatccagcactttttttccgttcagatcaggtaaaagcgaaaacatcgtaggcttttccaccacttcatttaggcttatcgggttttcacgcagtttaagatagcgtccaaagaaaatcgggttgtcgtagatgctggttttcatttgcaaaaatctctcaaatcctaccgcttgtaaatatcttcaccatcacggcgagttttcaagatacgcaagatccagacatattgctctggattttttggcacaaagtactcaatcacttcgttcatttgccgtgccgactgttgctcatcacctgcaaattcaagcggtggcaaaatttcaatttgatacacgcctttttccgcattgtaaatcgggaacattgggatcaccactgcatttgccacacgagccattttcgctagccctggcaatgttgctttttcagtcgcaaaaaatggcacatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatacacactaagctctgctccgaagtcttcatcgggcaaaaaataacccaaacaccctttacgcacatcatttaaaaagggtttaatcccattttgacgggtatgcattttaccgccaaaacgttcgcgagtgcgattccaaagccaatcgacaaggggattatgatgtgggttatacattgaaaccattggcattccataggtatgcataataatccccgacgcatcaatcgaccaagtgtgtggcacgagtaaaatcacgtttttcccatttgctctcgcttctcttacgatctctaaacccgaaaactcactacgtttttgaatatgttcaacagaacgcaacgcaatttcaccaattcctaacatcgtttgagcgacagtaataaacattttttcaatcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatcacgccaacgaaatggtacataagccaagatcactagtcccaacattcctagccaaattccccaatatttcgggtgtaaaaaggctttttgaaactgatgttgataacctactcgatatgtttcacgttctgacattcttttgtcctatttcttacggtcgataatatttttcaccgccaaaatcaatcccaaaccaataaatgccccaggtggtaaaatggctaatagcaagcctgaatctaaatgtagcagatccattcttaaggcttttgcccaactgcctagcaataaatccaagtcgtcaaacagtgtaccgttaccaataatttctcgtatcgccccaagcaccacaaggcttaacgtcatccccagccccatcgcaaaaccatcaaaagcggaatgggcgacactatttttggaggcaaaggcttccgcccgaccaataacaatacagtttgtcacaatcaacggcacgaaaatccccaaggattgatacacaggaaaggcaaaagcattcattaacaactgaatagtcgtcaccgcagttgcaataatcatcacataaatcggaatacggatatcgtgcggaataaccttacggaacaaggaaatgatcgtatttgtaatggtcaaaaccaataaggttgccaatcctaagcccaaggcatttgtgacattattcgacactgccaacaacggacacaatccaagtagctggactaaggtcgagttatttgaccatacaccttgcgtaaataaatttttccaaactgaagattttgcttcggctgtcgtttcttcaatttgcgtaatagggatttgggtttcttgcatattttatctcttgtagggtgggtcttgacccaccattttccataacatattgattttataggttggttaaaacctacccacaatgcttcatctattttgatgatgtattatcaatcttaaccattgagctttattaaccatcttcagtggatcctttatacaataaagcctattatttattaaaatttcttacatatcccactgatataaactgagcatatcatttttcacatcacttccccaatccatcggaaattttccattttgtacgtctttatgaaatgatgaataagcccaatcagatacattttttacataattatgtttcacagggttatagtaagtataagcaatatgtttttctaaatcttcttcatctctaatataatgctcccaaaaccgtctttgccaaatccctgcttcatttcgtttttcacgactaaaatttgggtttcgatgttctttgggtatcttttgagtaaatcttgttttcaaaaattttaatcttattgaatagtcatcatcattttcaggtaattgtaaaatcagatgtagatgatcaggtaaaatcgtaattgcaatggtttcaaacgagtatttctcaacagtttctttatatgcacaacgaaattcatcaatatatctaactaacaaatcgcttgttctatcctgcaaaacgatggtaaaaaaataaataccgccctgagtaaaattacgtcgataatttgacatactttttccaaaaatggtgggtcaagacccaccctacaatttattacaactcaaaaaaccttccaccatttcaggcttttgctttaactgagtaatcacccattttgcactttggcgaacattattcaccaccgctcttggtgtaatggtcgcaccagtaaattgatcgaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaccgtctttttttaccgcccattcgccttcattttctaagctaaatttgcggttggtgaaactgtaaatccaatcgtcaattcgggtttcgattttatcacccagcccaggggtttctttatgggcaagggttcgcacgcctaataccgtgccgtcaggctgaatacctatcaacagctctatattgcccgaatagccgtctggaacggtagcttgaatagcgtaagcggttagatccgagcctttttttgccatatggattttatttaaaaacggcacttcaggaagtttaaccactttgcaagttgccaatagctcattatcaaaatgtacttgtggcacaacttctaataataattgccgttgctgttctgccgtaaccacatcaattcgacttttagtcagcagataaacgcccgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcagataaacgcccgttgaaaccgccgtacatagtaaggctatcgctcctaaaatcagagcgtaacgtgtggtaatcactgatgttttcattgtctccgtcctaattttgtaccgtataaacggggttgagtatagtggtcgattaacggcacacagatgtttgccaacaacaccgcaaacgccacgccgtcagggtagttgccataataacgaatgaaataaatcaacaaaccgaccaacgccccgaaaatcagtttgccttttggcgtgattgaagcggtgacaggatcggttgcaataaagaatgccccgaacatcatcgccccactaaataactgagcttgagccgtccaacgagccgtttctgacacaaaatctgtcgcaaagctcaacaaggcaaaagtccccaacatcgcaacaggaatttgccaatgaataattcgcttataaatcaataataaaccaccaagcaaaaaggctaaattcacttgcccccaaccgccgaccaacacatctgcaaaaagtttgtctaactgaatacctaaggtcacattatctttaatgctactcatcgcctgttttgagccgtctaacactgtggcagacgacacgccatcgacactttgaataagttgatgaacgctaaagccgtccgtggtgacattcgcaaaaatcagcgaaaaactatccgctaacgttggcggttcgttcaacaacgccaacggtggcaaccacgccgtcatttgcacagggaatgacaccaacaacaacgcatagccaatcattgcagggttaaataaattctgccccaaaccgccataaacgtgctttgccagcaacaacgccacgatcacgccaatcacaatcacccaataaggtgcatagggcggaatagccatcgccaaaattaatgcggtcaaaatccccgacaaatccgccaaatagaaagcggtcgctttaccacgcaattttgcaacggcaatttcaattaccaccgccaagccaatcgccaagctcgcctgaatgaataccccgtaaccaaaaaaataccactgcaccaccaatgcaggcaacatagcaccaaccacccacagcataaaatttgctgtcaagttgttagaatgcgtgtggggggaactgatcattttaaacatcaaatgtttcctttatatcgtctaaatttgctaaatcttcggcaaatgcatattaaatttaatcgtgagcattcggattgcaatgaccgtcgttaccgttgccacatcaatccaattactttcaaacccagcatcacggaacaaaataaaaataataccaccaacaagacttgcggtcacatacacttctttttgtaaaatgatcggcacttcgttgcgtaaaatatcccgaataagcccaccaaaacagcctgttacaccgcctaatgcaacacaaattaacgggtgcaagccaaaatccagccctttttgcacaccaattacagtaaacacccctaacccaatcgcatcaaaaatcaacaagccttttttccaataatcacggtcgatctgatttttcaaaattgccacaatcactaccgccactgaaatcatcagcacataaatcggctgtttcatccaaaacacaggggtactgctaatcatcacatctcgcaaggttccaccgcccacacctgtcacaaaagctaatacaaacataccgaaaatatccattttgtgctggcgtgccgctatcgcccctgaaatcgcaaaaacaatagtaccaatcaagtcttgaataaataaaaacgaccacggaaatgggggaaataattcgttcatttgtgttccttaattattagttcatttacttgtgtcactttcataacaataatatatgtagnnnnnnnnnnnnnnnnnnnnnnnnnnnnnnnnnnnnnnnnnnnnnnnnnnnnnnnnnnngcagtgtgtccctactatgctatttctgagcttcttttttcgccttcgcccttgcaatcgctgctgcaactgcygcttttcttggrtcttccgcaacttcagcttttgcaacattttcatcagaaaccaccgcttgctgtgcttctttcttcgcttttgctctggctaargctgcygcaactgccgctttgcgtggatcattcccctcgcccgcttgcgggagagggacagattcaagcgacgtaatgtcgcgagaatcagggctgcttcgccaaccgtcttgccttacgttgtgccatcaattcgctgttatctggctcaccgttggctttggtttgaactggggtagccgtttctgcttttttcgcttttaagcgttcaagtgctgctttaaccgggtcttcaccttggctatttgccacttcttcacgacgtttttcagcagcttgttgaatacgtgctgtgcgagcttctttctctttatttaaacgggcttcacgagcttcaaaacggatcttcgcttcttccgcttgtttggctttttgatcgacttcttggatcttggctttttcttggcggaaatactgaataagcggaatgtaactagggcaaacgtaagcacaaacaccgcactctatacaagcatctaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttgatttatcgtgatcttctgcacgggcaaaccagtaaagttgttgcggtaacaatcccacaggacaagcatcagaacagcttgaacagcgaatacaatttcgctctggttctggcggtgcatattcaaagtgatcaggggcgataatacagtttgctgttttggtaatcggtgattgtagtgacggcaaaataaagcccatcatcggtccacctaaaaagacaggaaaacgttcatccgcttgataatccacttgttcaagcaaatgcaaaatcggcgtgccgagccttgcccaaacgttgcctttattgcggattttatcgcccgtcagcgtcaccactcgctcaattaacggctcatcgtccattaccgcacgttttactgcaaatgccgttccgacattgtgcatcacaatgcccatctcaatggttcgtttaccttgcggaatttctagccctgtcagtacttgcaccaactgatcgcttgcccccgacggatatttagtcgggatcactcgcacgctaatatcatttgcaccttttaacgccttttcgaccgcttgtatcgctttcggtttattatcttcaatggcgatcaccacttcttcagggcgaagcacatagcgtaaaatccgcacaccttcgatcatctcatcggcataatcttgcattaaacgatcatcacaggtgatataaggttcgcattctgcaccgttaataatcaataacttacagcgtttatcggcaaaatgtaatttgtgtgatgttgggaagaccgcaccgcctaagcctgcgatcccggcttggtaaactttttgaataatctgatcgcttgttaggcttaaaaaatcatcaatcggctgacgttcgatccacttatcttcgccgtccgtttcaatcacaatggttaattcgggtaagccagacgggtgtgatgaaacgtggggctgaatagcgaccacttttcctgaagtcggactatgaacaggcagttggcgataattatcccctttcgtcaaggcttgccctttcagcaccaaatccccttgctgaacaatcacgtccccagccgttcccgaatgttgcaacacaggcacatagaaaaatttcggcagatgtaacgaacggatcggcttttggttcgactgttttttcatttcaggcgggtggataccgccagggaaatcccataattttccttcacgaatacggcttaatacatcagcttgcattacttcccccaaccacaattttcttttcaacttcagtggtattcacaatcgggatcaccaaattcgcatcaaatttccagttccagttttgtgtcgtttgtttcacttttatcatttcaatacaatcagtcgggcaaggggcaacacagagttcacaccctgtacaaaaatcggcaatcaccgtatgcatcgctttgtttgtcccgataattgcatcaacagggcaagctgcaatacatttggtacaaccgatacacaactcttcgtgaatatacgccaccttcgccacaggctcttcccccgatgtttcaggcacatcaaccccaagcaactcggcgattttcaccaccgtcgcttgcccacctgggatacatttcgtaatgtcgtcgccatttgctaccgctttcgcatagggcttacaaccagggtagccacattgcccgcattgactttgtggtagcaaagcatcgatctgctcaacaatcggatcggcttcaactttcagcttaaccgacgaatagcccaacatcgccccaaaaatcaaggcaatcacagcaattgcaattaaaatatagagaataatggaatgatcgaacattagatttttaccaaacctgtaaagcccataaaggctaatgacatcaaccctgcggtaattaacgcaatggacgcaccttgaaaggctctaggcacatctgccgcgactaaccgctcacgcaaagctgaaaaaagcactaaaactaatgaaaaccctgccgctgcaccgaagccgtaaagcacagactgcacaagattattagataaattcacgttcaacaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcacgttcaacaacgccacccctaataccgcacagttagtagtaattaatggcaaatagatacccagtaaacgatagagagcagagctggttttgtgtacgatcatttcagttaattgcacaatcaccgcaatcaccaaaataaagaccaaggtgcgtaaaaactgagcttcaaggggaataagcagataggtttcgaccaaataagcagaaagcgaagcgaccgtcaaaacgaaggttgtcgccatacccataccgatagccgtttcaacctttttcgacacgcccataaacggacaaagccccaagaatttcacaagcacgaagttattgattaacgccgtactgataattaacagaatatactcaaccatttaacccacgaatttatcatcagaaaatctaaaaaatgtcgtgtattatcggcttttttgctgtaatgaacaacctatttacatcaactcacttacaagcggtcagggcaagatcgcatacaatgcatttcaatttgcaccttgccgaaaatcttgctaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaatcttgctaaagtgcggtacaatttggtgcgaatttaatattaggaagaacaaatgagccaagaatacttagattttgaattacctattgcagaattggaagccaaaattgaatcgctacgttctgtcgccgaacaagacgataaaattaatcttgatgatgaaattgcacgcttgcaaaagaaaagtgtggaattaacacaaaaaacctttgcaaatttagacgcttggcaagtttcccgcatggcgcatcatccaaaccgcccttacaccttggattacattgaacacatttttaccgattttgaagaacttgctggtgatcgagcctttgctgatgataaagcgattatcggcggcttgtttgatgagctacggttattgttaatcaaatgatttgttaaaaagagaggttattttgaccgctcttttaacgttataaaaaagatatttattattaaaaaggagttcatatgaaaaacctgatttctattcaatctcacgtcgtgtatggttatgcgggtaataaatccgcaacctttccaatgcaactgctcggagtggatgtatgggctttgaataccgtccaattctccaaccatacgcaatatgccaaatggactggtatggtgctacccaaagaacaaatcggcgaaatcgtgcgtggtattgatgaaattggcgaattacatcgctgcgatgcgatcatttctggctatatcggttcagctgatcaagtcgaagaaattgttaatgcggttaactatgttaaacaacgcaatccaaatgcggtttacctctgtgatccagttatgggacatccagataagggttgtatcgtagcagatggtgtaaaagaaggtttggttaaaattgccatgaaagcggcagatattattacaccaaatttagttgaattacgtgaattaagtggtttaactgttgataatttttcccaagcaattgaagcagttaaagtaattctagctcaaggcccaaaaaaagtgttggttaaacatttgagtaaagttggacaagatccgactaaatttgaaatgctactcgctaatcaagaaggcatttggcacattagtcgcccgttacatacttttgctaaagatcccgttggcgtgggcgatttaactgccggattgtttatggcgaatttgttaaacggaaaatccgatattgaagcttttgaacataccgccaatgcagtgaatgaagtgatgcaaataactcatgattctgggctttacgagctacaaattatcgcggctagagaatttatcgttaatccgcgcagccattatcaagcggtaaaaattgcttaatatagcatggatatttttgcaaaatttgagcatgtcgttagccaacatcaaccgacacaaacacattttctcgtcggttttagcggtggacttgattccaccgcattgctctctttattgacaaaattctgtcaaaaacgaccgcacttttccctcagcgccatccatactcatcacggtttaagcccaaacgccgatcattggatgacacattgtcaacacctttgtcgccaattgtccgttccactgatcgtggaaaaagtccaagtcgatcgacgtttaggcgttgaagtgggcgctcgcgaagcacgttaccaagccattcgtcgttatatgcgtgcagatcatattttgacgaccggccatcatcagcaagatcaaacagaaacctttttttctcgcactaaaacgtggcagcggcgtgcaaggcttgtccgctatgccgatgcaaagtgcggtcttttctgtaccgatttttcgcccactgctccaattcacgcgtaccgaactggaagaatatgttaatagcgaaaatttgccttggatcgaagatgaaagcaatcaagataaccgttatgaccgcaacttcttgcgccatcaaattttgccccacttgtgacaacgctgggcgcattttgaccaagccgtacagcgcagcgcgcaacattgcttagaacaacagcaattgttaaacgaattactggcacaagaattacaaaaatatcaaaaaaatgaccacacttttgacattagccaatttgcgcatttttctataccaaaacaaaaagcgttactgcgtttgtggttggccaattgcgatttacccatgccctcaagcaaacaattggcacaaattattcaggatgtgatcttcgcccaagccgatcgttatccagaatttaaattgggcgacaagctgattcgtcgctatcgccagcacttacacatcacaccaatttatcaagatatcagccatcttgttttgccgatatgcttaaaccaatccattgatttactggataatttgggcaaatttataattaaaacgcaatctaatgaatggattgcaaaatggcaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattgcaaaatggcaagattacatagttctccttccgccaacacaaaaacctatccatcttgcttttcgttattcgggaacggttctccaccatggtattcatcaagacatcaaaaaactgtggcaacaacataacgtcccctattggttacgccaacgcacgcctttaattttttatggcgatgaacttcaatgtgtagtggtacactaatcccgcagtcctcaataagtggtaaaatttaaccaaacatgaggatataaaaatgcgaaggcctagaagaacctttagtgcggaatttaaagccgaagcggtaaaattgattaccgagcgtaaatattctattacacaagcttgcaaagagctagacatcggtgaaacagcgttgcgtcgccggctaagtcaagttcaaactgaatgtcagggctatgtgttgctgggttcaaagccaatcagtcctgaacaacaacgcattcgagagttagaaaaccgtatcaaagagctggaagaggataaagaaattctaaaaaaggctacggcgattttaatgtctctcgagagcaatgataccaagcggtcacgacgttaaaatcgcacggcattaagcgtttatgtgccttatttggtgtgtcagaaagtgcctattatgcgcgtttgaaacggcgacaagcggtcgaaaaacacaccgcacttgcgattgaaatcaaggtcatttttgaggcaagtcgtcaatctgccggcaagcgaactgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgagacaaaagggaattcgagctagtttgcggttgattcgcaacctaatgattcaacagggattatttagcaaacaaccacaaaaatggcataaccgaaataaagaaatagggcaagtttttgctaatcacttgaaccgagaatttacgcctgatgcacaaacgacggtgctttgtggcgatacgacgtacattaaagtcaatggtgtttggtgctatttagcggtagtgattaacctgttaaaccgtcaagttgttggttggaaattgagtcgacaccacgatgcgcaattggttgtcgatgcgttaaatcacgcgatgttgcagactaaacgtacgaaaacaatgctgtttcactcagaccaaggcagtatttatgggagtaagcaatttacccagtgtgtgcaaaaacacaagctaacgcaaagtatgagccgacggggcaactgctgggataatgtaccgatggagcgttggtttagaaattttaaatatgagtggatgacatatggtggttatgttgattttgaaagtgcggtcaacgatgtaaaagattatgtgatgtactacaaccacattcgcccacatagctataatcaaggtttgctcccgatttcagctgaaaaaacttatcggggactgttgaattagttgatcactacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctattacactaaaattgatatcctaaggttgctaaaatatttcttgttttttgatttggcgtaagcgcactctctaatgccagctgagcaaaaaagccattgctaaaatttacttgtgagcttaaacctaaggtcaaaagagatggatttagtctatatgtttgcgtgaagtggctgtttgctatatcgctaaatttggcgttgttacaataatttctaccgcttaatctatgttgatagatcgcgtacgaattgaactgaatttgggcattgtctaatgtggttgcatagtttaataaaagccctgcccccatagccgttgagtgataattcacgctgtcgtatgattttgtaaaaatccgaccgctttcattaaatgcattttgatgtacaaaatcatagttgaaataagtcagtggcaatagcgtaacgttttctcgtttataggatttggcaacgcctagctgtgcactcgcaaagcggttttgataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcctgcgatattttctctttctcccacaatctgtttttcgtagcggttttgcgagcccccccaatttataccacttagtagtttgaaatggtcaaaatgcgatacataattcaatgcgatattaaatacctttgaacgagcattcgcagaatggaaagtgcctttgcccctttcataatttaggctcattgcaagctgttgtttattatcgatatttgtcgctacccccatacgcaatccgtgtgaattagctctaaacttatccgcttgggtgatgtgataacttggtgtcaggtagaacatatatttttcctgtgccaaattatttttggctaatttagacaaaaacagatcttcgccacccactaatttttttattccgttggtattgaaacgctgaacaaaatagtttggggttaagctaaacagtagattttgttgagcaaagtgggtggttttgatagtgctgtcgttgagcatatcaggcaaatgatcttcagcaatgctgtttaatacggcttgtctattggcggtattatccagtttcacaaagaaatcttgatatgcttggctgagatctgcagatgttcttgcggtataaatcgcttcaccaatgtcactatttggaatataaaaagcctcttttttaaccttaacttcagcgataagtgtcccttcttgagcaggtattgcttcagctttttccttctctttttctatgttgttcagctgttctgttgatacggtttcagagctactttcttcttttgccgtatcattaggcttaacttccgtatttggttgttccgttgaagctgtttcagaagtactttcctctgttacgttatcattaggcttaacttccgtatttggttgctccgttgaagctgtttcagaagtgctttcttccgttacgttatcactaggctgagcttctgtgtttagttgctccgttgaagctgcttcagaagagctttcttctttggcggtatcgctaggctgaggttcagtaacaggcttttcttcaatcgtatcatcattaattaccgtgtgatttgaagcgagtttaaaatccgctattttaaattccgttgagccattacttagaatttccacgctctcaaaacgattaaggctatttgctaatgagcctaaatcaatttgcactttctgccctgcggcataaaactgaccgcttaacggacgataaagtaattttccgcctttaatgtcgtaatgttgtgcaactagctttgaatttccttgagtgttgaaatttaacaccagtttagctgtgccgtgatgagtatagttttttccgaccgttaatgtcgcaatatcatcactgcccgcaataaccgtgcctttattgtctaaattgttggcaatcgtaccgcttccacttagggttccgttttgttcaacaaacactgaactttcgctaagtgctgagccactgtttaggcgtagctctccaccacgtaccaaggttgcccctttatagctgttgctaccgctgaaggaaagctgtccttgcccttgtttgataaatccaacattcaatcctcgcatttgttctgccggggaattttttgctgtggcaagatgtaggttgtcgtcccacattttttgctcgatattgttagtaaattcgccatttttcccttgggtatcaatcacataataggcttcagttttccctgttgggctttgaatatcacctaaatttaggcggtttgcatcaagtgtcgctacgccgtttaaggctttttgtacatcaagtatgccttgccccattaaatcttcgcgttttaggctatagagcgttttgttggttaagattttattgagtgtaactttatctttatcaggcgtatcgctatatccaagttccgctatatcttgcctgatttgagcctcgtctttcggtatatcctgatcaatatagatgacactaaatgcatcatagtttggtttctgtttgataatcaccttaggcaaggtgtaattttgatttgcggtagataacagcacatcggcgatctgtttgccatttaagaatgggaatttttgagcgacaagagcagctgcaccgctaaccatcggagcggcttggcttgtgccagttaaaggaataaattcctcttgctgttgtcgacctaacttattatgcacatcaaaaagggcatttgccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttattatgcacatcaaaaagggcatttgccgcatcaattttactgccaggtgccattagggaataagcctgagagcctaaaaagccgttggaatatttgtggataccttgtaaagtcaaggtcctttctccacctgaagaaagctgatttactcgtttttctttgataataattttgccgtcagaggcaatatctataccatcagcatctaacattcccactgcaataaatgagcgaatatcttcatcataacgaggtaaaagttcaaacaaagacgcactatttttcccatcattgcctgaaccaaacacatttaatactttgcgttctttggcaagtttaactatccgctctacttcatttttgttgttataaccannnnnnnnnnnnnnnnnnnnnnnttttaaggcttgttcatagttagagatattttgttcataaggaaaaaccttatagccccaactatgattgacgatgtgtaattttggatctttactgaaaaaatcaaatagatttaagccccaataattaaaatttgagctttctttaaacgcagctccataaaattttgcattaggggcaacaccataaggatcgccattactttcaannnnnnnnnnnnnnnnnnnnnnnnnnnnnnncaaaatccctgcaacgtgtgtgccgtgtcgaaatgtggcgttatctttttgtgctgaaccgatactacctgcatcatttttataaatatcatcaaaatttttataaccaccgatttcaatggcttttccctgtaagctagggtgttctggattgaataaagaatcaacaacaccaaccaccacattactaccatcaatagcagggttctgctctttggctttttgtaagtttatgatgttatacgatttttcaagggtcacaaaaagatcactggcaaaaaggctagggcttgataacacagcacagcattgcaaaggaaaaagaaactttttcatatgttgtctcctaaaaaatgaatattgttttatgtagggcacactgcgtgtactcgacccaacaaaaatcttaattcgtatcggcggatacctacactcactctgtttcgttatttataatgttgacaatcctactctcaactcacttgaaaacatagaaaagtctgtcaactggctaatacctattaatatttaacatattgtattcgtatattgtgtaatctttttcttgctaaatcaaatattggatgatcattctaaaaattcagtcaaaaacaaaaatgacgacattaagacgtaatgatacttatacatctatttgtctactgtggcaggttctgcatctcaatttcgtaacctcataaaaatcgagatgcattgtatctatgttggaaattagaacggctgttattggttaatccgtcctttcaagaaatccaacaactgatctttggcaatcatctgtttctcacctgtacggcggtttttatactcaatttctccattttcaagatttttctcaccgatgaccagcatatgtggcacaccgatcagttccatatcggcaaacatcacacctgggcgttctttacggtcgtcgaaaatcacatcaacgccttgtgaacgtaaggttttatacagatcttctgcaaaggtttggacactttcagacttgtgcatattcatcggtacaaccgcaacagtgaacggggcaatcgcatcggtcggccaaataattccgcgttcatcgtggtgctgttcaatggctgcggcaacaacacgagtaacaccgataccataacagcccataatcattgtttgcggacgaccatcttccccttgtactgtcgctttcatcgcttcagaatattttgtgccaagttggaaaatatgccctacttcgataccacgtttaattaatagcgtacctttaccatctgggcttgggtcgccttctaccacattacgcaaatctgcaatttttggtaaagcaacatcacgttcccagttgatgttgaagtagtgtttactatcaatgttcgcccctgcaccaaagtcactcattaacgccacacttctatcgataattactggaatcggcatattcacagggcctaacgaaccgacacctgcaccgattttcgctttaatttctgcttcatcagcaaattcaaacggctctgccacttcttcgcatttcacagctttgatttcattgagttcgtgatcgccacggataactaatgccactaacggctgttcttcgcttgcacctttaacaatcaaggttttcaccgttttttcaatcggtagattgaactgttcaacgagttctgcaatggtttttgcatttggcgtatctacaagggtcatctctgccgttggggcttgacgctcgccgacagcaatcgcttctgcaagctcgatatttgccgcataatctgactcggttgagaacaccacatcatcttcaccgctttgagctaacacctgaaattcgtgtgatgccgaaccgccgatagaccccgtgtccgctgcaacaggacggaaatccaagcctaaacgagtgaaaatattgctataggtttggtgcatcacatcgtaggtttcttgaagcgactctttgctggtatggaacgagtaagcgtctttcattaaaaactcacgcccacgcattaccccaaaacgtggacgcacttcatcacggaatttggtttggatttgatatagatttaacggaagttgtttgtatgaactcacttcacgacgcactaagtccgtaatcacctcttcgtgggtcgggcctaatacgaacgggcggtcgccacgatctttaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaactcagggccgtaatcttcccaacgctcagattcaacccataaatccgcaggttgcaccacgggcatttccacttctaaagcaccgcttttattcatctcttcgcgaataatattttccacttttttcaacacacgcaacccggtcggcaaccagttgtacataccagaagcaagtggtcggatcatacctgcacgcaacattagctgatggctaacgacttgagcgtcgttcggggtttctttcaaggttgaaaagagatattgacttgtacgcatttatttatcctatttgtatcaattctataaaacgaaatgggcggtattttaaatcaaaaagcggttagatcgacaaagaattttgcaaattgtaaaaaaatcctcatatctggccgcttgttttaggtaattttagagaaatgccgattcgatcaaaaatccactatggataatccctgagcataatgttagaattacccaaatttttcgctaaccgatagcgaaacttagttctggtgttgtggaaaataaaggctggtttgacttgtattaaaaggcttgaatttagcaaattttcctttacactattcaactctcgcacttagcgaatttatacacataggaaacaaaaaatgagcattgaagaacgcgtaaaaaaaattatcgttgatcaacttggtgcaaaagcagaagatgtaaaaccagaaacttctttcattgaagatttaggtgcagactctcttgacactgttgagttagtgatggctttagaagaagaattcgatatcgaaattccagatgaagaagcagaaaaaatcgctactgttcaatctgcgattgattacgttcaaaacaatcaataatctccatttagaaaaagcgacttttacaagtcgcttttttttctgcctcttattttttttctctaaatatatccgttcttaaattgcaaaactaaaccgttttagctactatgcacaatattatttttagactttgaaaggttaatttatgagcagaatttgggtgttaggtgatgccgttgtcgatttaattccggatggcgacaatcattatttgcgttgtgctggcggtgcgccagcgaatgttgcagtcggtgtttctcgtttaggggttgaggctggatttatcgggcgtgtgggcaatgacccactgggtaagtttatgcaacaaaccttgcaagcagaaaaggtttcaaccgagcagatgatacttgatccacaacaacgtacttccacagtaatcgttggtttagatcaaggtgagcgtagttttacctttatggtcaatccgagtgcagatcagttcttagaggtcaatgatctgccaaatttccaacagggcgaatggttacactgctgttcgattgcgttaatcaatgatccttcacgttctactacgattgaagctattcgtcgtgtcaaacaagcgggcggatttgtgtcgtttgatccaaatttgcgtgaatcactttggtcaagccttgatgaaatgaaaaaagtggtgaatagtgtcgtggcaatggcagacgtgttgaaattctctgaagaagaattgaccttattgactaatacgacaaatcttgaagatgcaacgaaagaggttacttcactttatccagagaagctgattattatcactttaggtaaagatggggcgatttatcacttaaacggtaagagccaagttgttgccagtaaagccttaaaaccagtagataccactggggctggcgatgcctttgtgagcggtttgttagctggtttatcgcaagtgtcaaactggaaagagagtgatgcggtattagttgaagtgatccgcaaggcgaatgcgtctggtgctttagcaacaacagcaaaaggggctatgtctgctctgccaaataaggctgagttagaggcgtttttaaaataatcgatttgattctcctattgtacaacccaaatataatttacctttactgggttgtacccccaaaaggtaggcgaagatatgatgaagagccattcttacaaacctttagcaaaggtctaatgcgccaataatgcaggggctttcttttggctcttcccccactacaacagtgatatatatttcaaaatccctttaattttttgtgaatcggcaatgtctaacacattatcctgtgatgaagttcccattcttgccgaacttattgaatccattagactttgacgttgccctttggctgaaaaatgaatttcaggcaccttggtttgttcaatgatttgtttaacattatctgcattgaccccacagccagccattacttgaatacgcccattcgcttgtttgactaactgctgaataacaggaatcccatcaaaagcagttgcagcctgtcctgatgtcaaaatacgatgacaacctaagtcgataagttgttcaagagcagtaatgggatctttacagaaatcgaaggctcgatgaaaggtgatctccataccttgtgaagccttaactaatagttctgttgttgctaaatcaatctcaccatttgcagataacgccccaaaaacgaccgcttgtatgcctagctgcttggcggttgcaatatcgttgagcattatctgaatttcatcttcgctatacagaaaatcacccgcacgaggacggatcatcaaggctaggggaatagtcgaaatttgttgagcctgctgaataaagccgagatttggtgttaagccaccaaccgcaagggcagaacataactcaatacggtcaatcggaaattgatttgcggtgatgaccgactctagattatcgacacagatctcaactttcatttattcccccacgataaagcgataatgaatgtaatgttgataaggttcgtttgctttgctaattccgccatagtgccaccattcagggtggtttggggtatctgggaaaaactcaggttctaaagcgacccctgcataatcaggatagcttccgcccgtcaaattaggctgtccgcccagccagttccctgtatagacttgcaatgcaggtttgctggtacgaagttcaaggcgaagattatcataagttaaaacagcatcggcctgacaagcggtcagatcttggcaagattttgcaagtaaaaaagcgtggtcataacctttaacagcttgttgatcggtatcagccagtaaatcttgacctatcatttttgccgtgcggaaatcaaaacttgttccttcaacagcttttaatggggcgttcggaatgccattagcaccgacaggaaggtatttctccgcattgagttgtaggctatgttgatgaatggtcggttcattagaaagattgaaataggcgtggttggtaaagcagagcggtgtatcttgagagcttaccgcattaaattcaatctcaagttgattgccgttcaaacgataaatgacagtcgcagtcacttcaccgccaaagccttcttcaccattggcgaaaattttgtgaaaagtgaccgcttgttcatctgccgattgcacctgccacacacatttatccgccccgatttccccaccgtgtaaattattttcgccattattttttgccaaaataaacttttgcccattaagctcaaaggtgccatttgcaatgcggttggcataacgccctaccgttgcaccgaaataggctgattgctcttgccaacgttcagacgtggtggttactaatacttctcgttgttcatttggcaatttaactacgcaagaaagccaagatgcaccaaagtcagatagagtgattttgagatgatcgttttcaagggtataaattttcatatttgctctctttatgttgcttcccctctcccacaagcgggcgagagaaatgatattatgactgcataatttaaaccactctcaccccatcacttgctgtgcaaacatagaaagtttcttgaatgccggtttgtttttggtagttttctgcgataagtttacgcaacgcttccactttttcatttggaactaagcagataatacaaccgccgaagccaccgcctgtcattcttgcaccgccatttttgccgatagcgacttgagctaattcaactaaatagtcaatttctgggatagtgatttcaaaatcatcacgcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaaggcttcaaccgcttctagtacacgatgattttcgctgataacgtgttttgcacgtttgtaggctaattcattaagctgttgtaactctgccgctcgctcaataaattgttcagggctaacatctcttaaggctttaacgccaaagaattgtgccgcaaattcacactcttgacggcgactgttatattcccctgtgactaaatcgtgtttgacgttagagttaatgatcgcaatgaaatagccttgtggcacgggggttgggctaatgtctaaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctaatgtctaaactacgacagtcgatcatcacaaggtgatctttttgtcctaatgccgaagtaagttgatccatattgccacaatttgcaccgacaaatttattctcggcacgttgtccgattagggcgttctccgctagactaatcggtaaattacctaacacttggcaagttttaccgatagaaatttcaagagcagcggacgaacttaaccctgaagacatcggcacatcactggtcattgcaatatcagccccttgaataaattcagggcaacgctcttgaatatatttcaccacgccacgcacatagtttttccatttatcttcactttgtggaatttcttttttaatatcaaaggcatcggtttcgttaatatcaatcgcatagacacgccaaatggagtcgtcacgtttcgcaaaactcacggacataccgtagttgatcgcacaaggcatcacaaagccatcgttataatcggtatgttcaccgataatattcacacgacctggagcaaaaacggtttgctgtgacgcataaccaaaatgttgttcaaattgagtttgagagagttggattgggggcattgttatcttccttcttaatttgttatttcggggcgggcacatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctacaccacgcaacaatttgtccgtctaattcataaacctaaatcggatatttagcatgatttagattgctgattaaaccacgtttggcgactttccttcgttgctggaactaaatctgccgtcactgtgcgtctttcaatcacctggttataaatttcaagaattcgagttaaatcatcttgttgtgctaggcggaacatctctatccttaaacttgctcggtacttaactgccaacctagttggcgatattgtttataacgttccctcgcttggaccttttctgtttcatcaaccgacacgaaatcaataatttgattgaagctgttaataaaattgggtaattctgtttgtaatgaaatcaatacatctcggcgttgggcattgcgtttgcctttccacgaaatttcaatcggggtcgcataggtggtgacttcgccggacagattatgtggtacaaaatcatccgcttctcttgcccaaagtgcttcatcaaggttgaatgcctgttcttcggtttcacaagcaatcagcactcgcttaccttgtcgccacgcttttgccgctaaatcgcacgctagagcttcttgggcggagagttcgcctgcttggacttggcttaatagatagaattgtacttgcttcactgacatactcttagaaatatagttagacgaattataacttatatttatcataaaacagatgtttgaaaatattcaaactacatttaatgcaatgtaaattgaaatttaagttaatgaacgttcattatacatctcctcaatctgctcccgatagcgttgcataatcactttacgacgtaatttcagcgtcggggtgatttcttccattgccgtactaaaagcctgaggcaagagagtaaatttcttcacctgctcaaagctcgggagttctttttgcaactcgtggatacgtctttcaaacatctgaataatgtcggaatgtttaatcagctcgatcctatcctgatatttgatattaagttgctttgcatattcctcaaggctatcaaaacacggtacaatcaaggcagaaacatacttcttcgcatctgcaatcacggcaatctgctcaataaacttgtctttaccgattttgccctcaatgtattgcggagcgatatatttcccatttgaagttttcatcagctctttcaagcggtcagtaatgaataaatttccgcaactatccatttcgccaacatcacccgtgcgtaagaaaccatcttcggtaaaagcctttgccgtttcttcaggcttcttatagtagcctcgcattaccattccaccacgcaccagaatttcattttcctcaccgattttgacttccgcatttggcattaatgtcccgatagaatttggattaaagcccttatcttgccagcaagaaaccgttgcagtcgtttcagtcattccatagcccaatttaatgttgatcccaatactgtggaaaaatgaaccaatagaggcttccaactttgctccaccgcaaggcatcattttgatcctaccgcctaataaagcacgcagtttagtcagcactaatttgtctgccaaagcatattgcaaacgaagccactgtgagggttgctctgcttgataatgctgttcaccaacacaaattgcccagttgaacaaagctcggcgatgtgccagggctttttccactttatcccataccgccgtataaattttttcatagaaacgaggcaccgcacacatcaccgttggtttcagtgtagtcaaggcatcacggacgtggttggtgtcttccaagtagcaatttgtcgcaccacgatgaaaaacataagcaacccacgcacgctcaaaaatatgcgaaagcggtaggaacgaaagcgacacatcatcttcattcacatttaaggcaagatcgtgagcatttaattgatgggcaaggttagcataatccagcatcacaccttttggctcacccgttgttccagacgtataaatcagcgtaaaaagatcggacaactgtttagaattaaggcgtttctcaaattccgcttcatttggaacaacatctagaaaatcttcccaataacacgcatttggcagatccctcaaatccatattcgccttcattgccacaattttcattaattgtggacagttgttcgctatttgacagacctgatcaagttgttcttgatcaccgacaaagagaattttaatgtcagcgtcattcacaatatattccacttgtttagccgtgtttgtcgcataaatcggcacagcaaccgcccttgcctgcattgccccaaaatcagcaatagtccaacgaggcatattatttgcaaaaataccgattttatcttggatatcaatatgttgagcaattaaagcataagagaaacggtcaatttcctgttgaaaagtttgccacgacatttcctgccattgagcttgttcacggaaacgcaaagcggtacgattaagccatttttttgcttgcaggcgaaatctattcacaaaatggaagtcgagagaagccatctttttatcctgtttattcagcttacaaatgttcgctaatatacttttttcattgagaaaaagctagagaaatgtgaacaaatgtaagctgaaatatcgcctgtctgtattcttaagtaatcgtaatctgtgccttttgtatcattgactgccttgctgcatctgccacttttacaccaaatggacaacaggcttatcttcaggcaatgtgccagatatgagtacggctttactaaatcacgtcattgaaatgattaatttcggtgcattgcaaccgataggcgatctaattgtagtgcaatttatgaaggtacagttaaagggcaaaattattctattccgctctattctcacgctcaagtgatgtgggtacgcaaagatttgttagccgcaaataatttaagcgtaccgaaaacgtgggacgaactttaccataccgcaaaagcattgacgaaagatggagtgtatgggctttctgttccaatgggaagtaacgatttaatggcaactcgctttttaaatctttatgtgagaagtgcaggggaaagtttattaaccaaagatcttaaagtgaacttaaccagccgctcttacaaacctataaaatcctataaatagctgtaaaaagctataaatatagcgatttctgttgtattcctgtttcaaccttgctggttacaagcgacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcctgataaggagctttccttatgtattaccgtcgcaataactatactagatggatattcgtatgacctgcgttgttgatcgtttcggtactctttgtatatccgtttctctcaagtatcttttatagtttaccaataaaaacttgattatgccgacatatagctttgtaggattagccaactataaagcggtgttgtcagatcctcgcttttggatgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttggtcattcattaatgtggacagccttatctctgataggtcaggtgttagtcggtttcttacttgcattggctttaaatcgggtagaacgttttaaatggctttataaaatcctgttaattgtgccttgggcattcccgacgattgttatcgcattctcttggcaatggattttaaacggtgtttatggctatttaccgaatatgttggtgcagttagggctgatggatattgcccctaattttctcgctgatcgcacttgggcattcgtttgtctagtctttatcaacatttggtttggtgcccctttaataatggtcaatattttgtccgcattacagactattccgtccgatcaatatgaagcagccaaaattgatggagcaaatatgtggcaagtgttccgttatatcaccctaccgcatattaaagtcgttgttggattattagtcgtattgcgtaccatctgggtatttaataacttcgatattatttatcttattacaggtggcggtcctgctgatgcaacgatgacattaccaatctacgcctatgatatggggtggggaagtaaattattagggcgttcttccgcagtaactgtattgctctttatcttcttactatccgtttgtttcatttacttcaaaattattaaccgttgggaaaaggagagtaaataaaatgaaaaagaaatcttcattatttggcgacatcgtttcccatcttttcttagcaacttcaacggtcattgctatctttcctttggtatggatattcatttcgtccgtaaaaagtaaaggggaactcaccagtgagccaactcggttctggccgaagatattcacactagattactttgaacacgttattaacgatctcaacttcattgtgaatattaaaaacagtctatttatctcgctagttacgaccattatcgccatcaccatttcggcaatggcagcatacggtattgttcgtttcttcccgaaattaggctcgattatgtcaagattattggtcacaacctacattttcccaccgattttacttgccattccatactctatcgcaatggcaaaagcagggctaaccaatacaacaagcggtctgatcatcgtctatctttccttcagcgtaccttatgcagtttggttgctagttggattttttcagactgtaccgattgaaattgaagaagccgccaaaattgatggagcgggtaaattcaccatcttcttcaaaattgtcttaccacttgtggcaccgggtattgttgcaactgccatttacacctttatcaatgcgtggaatgagttcttatacgcccttattctcgtcaatgataccagcaaaatgacagttgccgtggcattacgatctctaaatggtgcagagatcctagattggggcgatatgatggcggcttcggttattgtggtcattccatcagtattattcttttgttttattcaaaataaaatcgcaggaggattatctgaaggctcagttaaataaagtttcatcgctatcggtaaaggtaaattctgtattttaattaatttaggagacaaaaaatgattagatatggtgttgttggcgtgggctattttggtgcagatctcgcacgctttatgaatgaatttgataatgcacaaattacggtggtttacgacccagaaaacggacaaaccatcgtagaagaattgaaatgtgatgctgcaaatagcttggaagaattagtaacgcgtgatgatgtagattgtgtcattgtcgcaacgcccctgagtttggtgatgaagacgatatgttatttgtcaatttggaatttgatgataaccgctttgctgtattggaatggggatcagccttccgttggggcgaacattatgtgctaattcaaggcaccaaaggggcaatcaagctggatatgtatcattgcaaaggcatattacgccttgatggcaaagagagttatttcttggtccacgaaagccaagaagatgatgatagaacgcgtatttataccagtactgaaatggacggtgcaatccaatacggtaaaccaggaaaacgcaccccaatgtggctaagttccattatgaaaaaaagagatgaaatatctgaacgatattttacacggtatgcaaccaagtgaagaatttataaaactactcacgggcgaagccgcaagagctgctattgcaaccgcagatgcgtgtacgctttcagtaaaggaaaaacgtcgggttgaattaagtgaaattattcattaaataatggaaattaaaaccgcactttgaaaaagatagtgtcgtaaagtgttcataagttttggtataacggtaaattatacttgcttatgaacacttttatttagcgagttttgagagaatagcttgtttgtacttccaaagagtagtgaaacaccgcttctattcaaccggagccactttctcaatcggagcttgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagaagttgtcaagcaagcactgacattccttgaataaattaattccatgtagttgttagcaaaagtaatttctgtaccatctaacagctacatgatagtaccaacagaactaaatattctctaactcttccaactcatccgccattgcacttaatgcatctcgagtaagttgggctaatgccttataaaaaccagtatcaaaggcttctactttgcctaagaacttgcttaaacaaggtaaaacaaaatgttcaaagaaatcacgttgagcctcggtagaattaaggttatcttcaatccaagaggctgttagcagtagtaatgcaacgtgatcgggattggctaattcaggcatacctctttgttggcggaaggctacaaagtcggcaacggataatccataggcagaaattgttgtagcaatagctccattttccgcaaaaagagcttgataactgtccgcttgttccgtagggttagcatttttttctacggttgtgagggcagcttcgctctgctcatcggttgtcaaagcccaagtttgacgaagattaccctgttttaaccacgcaaaagtccctgctaaaataggatccgttggactgcgataaaagagattgccgaataaacggcatagtagagaaaagtcgttgattgttgtttgattcataaaatcagtttccgtaaaaatgaaagcggtatgttacacgaattatttggagaaaataagatgaaatatattggtgctcacgttagtgcttctggtggtgttgaaaatgctgtattacgctcagtcgaaattggagcgaatgcctttgctttgtttacgaaaaatcaacgtcaatggcaagcaccgcccttaaaagcggatactattgaaaaatttaaacgtttttgccaagttcaccatttttcgccagcacaaattcttcctcacgatagctatttgattaatttaggcaatcccgaagcggaaaatttggcaaaatcacgcgaagcctttattgatgaaatgcgacgttgcgatcaattagggctaaccttgttaaatttccacccaggtagtcatctaaataaaatatcggaacaggattgtttagcgcgtattgccgaatcgattaacattgcagttgatagtgtgcctaatgtggtggcagtgattgaaaatacggctgggcaaggctcaaatttggggtggcggtttgaacatttagctgaaatcattgagcaagttgaaaataaacagcgtgttggcgtttgcctagacacttgccacttattttcggctggttacgacatcagttcattagcctcttgtgaacaaacttttgctgatttcgataaagtggtcggttttgaatttttgcgaggtatgcacttaaatggctccaaaacaccgcttgcaagcagagtagatcgtcatcacacattaagagaaggcacaatcgggacagatgtctttaaatttattatgaataatgctcattttgacaacattccgctcattttagaaacaatcgaacctgaaatttgggctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacctgaaatttgggctgatgagataaattttctacgttctttggaacaaaattaagttatactggtctgacgtggtgggttttgtgcggaacaaaacctttattttatacaaattactttaatttttagttgaggtaattcgcttttctagttctggcgagacaaatttattatgcaaaaatcattattttctttaaccaaaaccgttcttttttctctgaccattgcgttgtctattgggtatagttcaaacgctgtcgcaagtttgagtaccaaacctgcaaccccaacgcagttaaataaagcaaaaacaacggcaaaatttgcctcagcaaaaaaacaagatgtgacacagaaagtaatgaatgtctatcgtcaatgggctggaactcgctaccgtctaggcggtgaaagcaaagcaggtattgattgttctgcttttgtgcaagccattatggattctgcctttagccaacattttcctcgttcaacagcagaacaacgacatatgggtaaatccatctctaaatcagaattacgtccaggtgatttagtctttttccgtaaaaataatcacgttggtgtttatatcggtaatggcaaatttgttcacgccagctcaagccaaggtgtaactacaagttctatgtcagagagatattgggctaaaagctatactcaatctcgtcgagtgctttagattccatcctgtatgtttttagctgaaatgctatttcttatcggtataccttttgagcaatggtcacttaaataaccagattgaaataaaagtaacaagtccatttcatcatgggtattgtatgtcaatacaaatcaaagtctactataaatttacttgataaataatgaaatttattcaataatggaggtgcactttttagttagctgtataaacctaatttagtgctttcatttattaaaaacaaggggagccgttttcggcgttatcacccacacaagaggaaactttaaaaatggcaaaaaaagtccaagcctacgttaaactgcaagttgcagcgggtatggctaacccatcaccaccagttggtccagcattaggtcaacaaggtgttaacatcatggaattctgtaaagcattcaacgctcgtactgagagcttagaaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttaccaattccggttgttatcacagtttacgcagaccgttcattcactttcgtaactaaaactccaccagctgcagtgttattgaaaaaagcacttggcttaaaatctggttcaagcaaaccaaacaaagataaagtgggtacagtaactcaagcacaattacgtcaaatcgctgaaactaaagcagcagatatgactggtgctactatcgaaaccaaaatgaaatcaatcgctggtacagctcgctcaatgggcttaatcgtagaggaataatacaatggctaaattgactaaaaaaatgaaagcaattaaagctggtgtagattctactaaagcttatgacatcaatgaagcaatcgcagtattaaaacaattcgcgacagctaaattcgttgagagcgtggatgttgcggtaaacttaggtatcgaccctcgtaaatcagaccaaaacgtgcgtggtgcaacagtattaccacacggtacaggtcgtacagctcgcgtagcagtatttactcaaggtgcaaacgcagaagcagcaaaagcagcgggtgcagacttagtgggtatggaagatcttgcagagcaagtgaagaaaggcgaaatgaactttgatgttgttatcgcttctccagatgcaatgcgtgttgtaggtcaattaggtcaagtattaggtccacgcggcttaatgccaaacccgaaagttggtacagtaactccaaacgtagcagaagcagttaaaaatgctaaatctggtcagatccgttaccgtaacgacaaaaatggtattatccatactacaatcggtaaagcagacttctctccagatcaattaaaagagaaccttcaagcgttattagcggcattagtgaaagctaaaccgacaacagcgaaaggtatctttattaagaaagtaagcatctctaccactatgggtgctggtgtagctgtggatcaagcttcactataatttcttatagatagattaaaagccgcttaaagttcatgctttatgcggcttttaatttttgcttaccacgcttttccctcaaaaccctccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcgatccgctcgctgattaaatccatcgtctgatcgttaagcaacagctgaatattcaacttcgggtgtaactgcaaaaagcgattgaccatttgcactaaatgatacgccccgaaagtttggctactggtgacacgcaacgcaccacgcaattcaccctgctgtgccnnnnnnnnntgttccatctctgcggttaagtttgcaattctttggcaaaaaagcaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcacaaactttcagtccatatatcctattaatcactcgtgtattagtcggttatatgtttttacttcatggcaccgcaaaattctttgagttaccgatttcaatgacaggcggcaatggtgcggtaccactcttttctctgtttggtgtagcaggtgtattagagattgttggcggtatcttgttgattttaggtttatttacccgtgcaacagcatttattctagcaggacaaatggcagtagtctattttatattccacgctgcttcaggggcgattttggatccaattagtaacaaaggtgaagctgctgcattatttagtatggcattcttattattgtggcatagtggtgcaggtaaattatctcttgatgcgaaattaggaaaataataggggctgtcctagataacgactaaaatagagcttttagtcgttatctaggacagccccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttatcttagcattctatcccaaaaactatctaatttccaattttgtgggatatccatatattctttttgaatctagtctgatggtataaagcaaggcttgggtagcaactaaaattggatatttaattgttggaaaggaatagtataagctgaaaaacgataatagctgatatgttctaaatagcgctttgaacaagcttcatcagggatttctttccattgttgtaaaagttctctgtttgattttgcaggtttgttgaattgatttatactccatcttccgcataaaaaactgcaaggttgtgcgtaactaagaaacttattcatagatatagcagatatatttttgagcatggtagaacaaactaaagatttcacaactctagttttatgtaacaaacgataaaatttgaagaacatggtacgaattaaccttttatccagatagcacaaatgcccatacttacactatctttttccccacctcttgtgtattttgcaaaattttcccaaatcccaccgcttgtaatttatccttattaccactaaattttcttgcattcccccctaattagcctacaatccgcatcgcctgaatggctaagtttttatgcgactttggtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatggttttatcggcggtcacattggcatttgcaagccatcaagcagtagcaaaaggcgataccgcctatctctatacttggtctgaatacgtacctgaaggtttgcttgatgattttaccaagcaaacagggcttaaggtgatcgtttctagccttgaatcaatcgaaacaatgtatgctaagctaaaaacaatgggtatgatgtgattgcacctacaagttatttcgtttcaaaaatggctcattaattgaacggatggcataaatgaaaatttatgccactttttatactttaaataggtaatgttatttcataaattattaggagaagatcaagtttaataaactttcaaagatgaataaactttattttatttatacttatttaagtgcttcattaatgatttggattttttatctttttctggcaataaacaatatttccttgttttggttttttgacgctataatttcttttttatcatggttattaatgggagctgcattaacctatagctattctttatcaagatttctttcgcataaacatcgagaaaagatcaccatattctgctttcttatttttcttttgttttgtatttataaagaaattatgccaattcaggatgatatttatgtgaaagtatttaacggtattcgagagttttttatgctgatgaatgcggtttattttggtactctgctattaaaggtatttaaggtgaattatatgaataaccagaataaaatatctaagatatgggattaatgtatcacaagcgctttatttctataaaaactttgcaagttaaatttaatcggtatagtagacaaaatagttgctaaaaagtgatttgaagccttatagcacaaggatttaggtctcctttttgatatgtgaatgaaaaattgtccattttgctaaagcccggaaaaattgagtaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaaaatgaatttaaggtaacaacgctagccccaattctttcaaaaatacattatgtttagctgttgcaactttgatttttgcatccaaatccatcaagacctgatgattggcagccaaatcaatttcttcttcaacagcggtattattaacatagcgggcgatatttaggttgtagttgttatcttcaatttcctgcacggaaatgcgtttggcatagccttgtgtttctttgcgatattgataatgttcgataatttttgcgatatgctcgtcagtcaaacggttttgacgtttgcctttttcaaaggcatcagctgcgttgacaaataaaatatcgtcttcttttttgcattttttcaacaccaaaatacagacgggaatccctgtagaataaaacaaattagctggcaatccgataaccgcgtctatatttccatcgttcagcaatttcttacggattttttcctccgcccctccacggaacaatacaccatgcggcaaaataatagccattgtgccgttatcacttaaaaagtggaatccgtgcaataaaaaggaaaaatctgcagctgatttgggagcaagcccatagccgttgaagcggaaatcattggccaaatcttctttgggatcccagcggtagctgaacggcggattggcgacaacggcatcgaattccagttttcttgcaggattcatttcattcagaatatcccaatcattgattaaagaatcaccatgatgaatggcaaactccgtatccttcaccccgtgtaacagcatattcattctagccaggttgtaagtggtgatatttttttcctgcccgtagattttgccgatatgtccgccgttttccgccatttgatgacgcacattgagcagcaatgaaccagaaccgcaggcaaaatccagcacgctatccagttttttcttcttaccgctggcggggttttggctatccagcgttacgatttgcgataaaatagtggaaacttgttgcggcgtataaaattcgcctgcttttttacctgaaccagaagcaaattgggcaatcagatattcataggcatcacccaaagcatcgctgtcggcagaaaattcactgataccttcagcaatacgtttgacaatttcagccaatttgttgttgcgctccgtatagctttttcccaacttttccgaattcagattgatttcggaaaacagcccgccaaacgtgctctcaaaagattcgttttcgatatatttaaaaccctgttgtaaggtgcttaacaactcagtgctctgcactcttgccaattcggcaatactgccccacaaatattcaggcttaatcacataatgcactttgcgtcgcatttgcttttcaaaatcggcggtaaagtcagcattttcttgataccataccgccaaaggcgtgcgcttatcatcattgcttaattgcggataatccctacccagctctttttgcgcagcaagttcgtaattatctgataaatagcgtaaaaacaagaacgatagcatgtaatcacgaaaatcgtcggcattcatcgccccgcgtaattggtcggcaataccccataaggttttacccagttgattgagttgctcttgggtcattgttgtatctctttaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggaaacaattgctgcatcaagcctttcttatgggttttcagacggcctatccgttcgttttgttcgttaattagattatccagtgaagacaggcaatctgcgatggcttgttgttctttaggtattagcattggtaaaggcatagacatgaaatcattatttgtaatattcatacgatcgtatctagccccactatttgaattttgctgtaaatacttgtgccaagtattggttttaaaaaaatactcataaaaatcgttttgttcatttttaaatctaaaaactgtataaagtggtgacattacaccaataccaactttatttttagaaataggacctacaggagctaaatttgaaatccttggattataaacataatctccaaattcaataatgtaatacccatcgagattattcttattggctatatctctatcaaaataatccccttgatcaattacaccatcatttgcagaattagttagaacacgaataatagcgttatctttatttttaaccgtaactctattagctaacacttttaattcaacaacctcccaccccttacaatttctaaattgcggaaatctaagtttcggataaactatcttgcttgcttgcttgcttgcttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgcttgcttgcttgcttgcaaatcattatggcttgggaataattgctgcatcaagccttttttatgctgttttaaggcggcaagtttttgttcctgcaattcgattaattcatcaagtgaagaaaggcagtcggcaattttttgttgttcttcgaatgatggaattaaaacatttacctcattaaaaaattcttgaatcccaatattcaacaatccatgatttcttgcaccttcttgggctactttcccaatatcattattttgaacaccagcttcaaaatagtgttcaaaaaaattaccatagtttgaataactttcctttagtttgaaacagatatataaggttgaaactacacctttatcatatagcttcaatggctttatagccccataaggatatccatttgaatagcttttattgtatgcaaaatctcctttatgtagtaaatagtatcctgtaatatctttggctgagacagatttattaaaaaaatccaactgactaattaatccatattgagctgaaattgttagtacattttgattattttctttattttttagcgtaattcgattaaaaactgttgataagggacgattttcccactccaatgccgtctgaaactcaggaaaacgaagttttgggctcactctttcttgttggttttgcttattctgttctgaatcattcattttttatactcttggatttgtatattgcttaggcaaccagccgttctacaatttggctgcgttctgtccataaaatcggttcgatatcgtaatttcttagtgcgtcaatcgccgaagctgcgacttccgtttcgctattattgagcaaaacaaataattcggaattggccgcacggttttcacggctgtccgtccatttgaaaaccgttgcttcaatggcattttttttcgggttgccgagcgtttgcaagatgcgttcaggctgtttgcgtgatttgggaataacaaagtcaaacatatggtcaaagccgcttttgccggtaaatttgatattgggggtatagcgtatatccgagtgatccagccattgcaccacatcttcataaaacaggttggcaacgtagggcgaagccaaataaaacaggtcgttaaccgccagcatggcttgcaggaaattatgttttttcaaggcgaaattttcggcgctggctttgagtatcaaggtttcgccgtcgagctgaacgccgaatcctgccaaagtcatttttaataatgctttgcgtttttcgctatccaaagaacagccggaactgattaaatcgtgaatgatatagccgtcatcactgagcaaaaaaccgttggcttctttgcggatataaaattgcaaacagtcgttatgacgatccaaatgcggagtggtaacctgcacccaatctttatcgatttgttttaaagccgttttgtctttcaaccattggagatattgctccatcaggctttgtatttcatcaatcatatgaataattctctttgaattaagggcttgccgataatatggcaataatccataaatctatccagtagatcataagggctgtctaacactaatttgagttcatcaggcagcggataagcccatttgtcgccgtagccttcccggtagaggtgaatatgcgggcaaataatttcttcaccatcgggattgcggtgcggcgggccttcaatatccaggcgaaccaatacaatggcttttctggcccgggtttggaaggtgattttttccaatgcgatataccctctggttacatccaagttaaaagtttcttttttatccattgagtgtaacgacaagcgtaatgaaccgcccatatagggaaatttgtattctccattgctgaaatcatatttttccaatgtcaataatgcatctgcctcttgctgtgccagcatgttatttatccttagatcgtttattcatacgccttcaagcctgaaatttcttttccttttgccatatttttcagcaagggaacgaggtcttccattaaggctaattctttaatacgccgttctttccagcttaattccaaaggttcgagcaggtcggtgagcttttcgccgtcgaaaatcatgcggtttaggatttcttcgataaagcctctcaaagtatcggttgcaataccgtgtttttgcgcaagtgcggtcagttttgcgtttgtttttgcgtttctgaatgcctgataaccggctttaacttcttgctcgttgagtgcttcgcccgctttcaggctgtctatataggcaatgatgtcgtctttttcatccatcaaatcgctgcttgcggcaactagttctactaattgcgtgcggctcatctgctgttttttcggtttggatgagttttcagcaatcagtttcatgatgtagtcgtaatcgatggttacggatgaaaacaacacaaattcaaagtctaattgctcaagctccggcgatggtggcgtttttccatataacgcttgttctttgatttgttgcgccatatccagatacacgcccttaaaagcgcgctgggtatcgcttggcaaaatattttcaattgcctgcttttgctcttcgcttaaatcggtatattgccccaactgggttttgtaacgctgcacttctttaaacagattgataaatccggcacgggcgttgtcgcctttcaggttatgtgcttcagacggcgtacaggtcaatccctgcgatgacatgaaatcttccagttgcgtcatggcgttttgcagtttggttatgacgatttccgctgggtcaacaatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccctgaaaaacgcttgatggcttcgtctacttgcgcctgctgtccgcggaaatccaagatattaccgtagggtttggcagaatttaatacgcggttagttcgggaaaaagcttgaattaacccgtgatatttcagatttttgtctacataaagtgtatttaaatatttgctgtcaaaccccgtaagtaacatatcgacaacaatggtgagatcaattttgttgctgtgtggataatctttatcggagtattggtggtctttaattcgtttttgcacatcttggtaatatagatcaaattcattgatactataattggtgtggtactgcacattgtagtcatcaataatagcttttaaggcggcttttttgccgtttggatcatctttattgtcttgttcctcctgaggcaaatcggcttggatttgggcaatgtcttgattgccttcggcgggtggggaatacacacaggcgatattaagcggtgcgaagtcgggattatctgcctgtaacttggcttgtgcatctttaaaaatatgataatagtcaatcgcatcattaatggatgcagtagcaaaaatagcattgaaacgacgctcggaagtggcggcatcgtgcttgtttaaaatggaatcaacaatcgcctgcttggtaacgggatgattggcagatacgggcttacctccatccgccttgtaataatcaatatggaatttcaatacattaccgtcgtcaatggcattggtaatggtgtaagcgtgtaattgctgttcaaaaatatcttcggtggtttgataagatgcgtccgtgccgtcaatgcgtttgtaactagcattttcttcaaaaatcggcgtaccggtaaaaccaaataattgtgcttttgggaaaaatttcttgattgcctgatgattttctccaaattgggagcgatggcattcgtcaaaaataaaaaccatacgtttacctttgagcgcgcttaattgtctatggtgggtactattttctttgagtaccaaccccagcttttggatggtggttacgatgactttattggcgtaatcattcgaaagtaggcggttgactaaagtagaagtattggtattttcttctaccgaaccttcttgaatgcggttaaattcttcacgtgtttgacggtctaggtcttttctatctactacaaacaagcatttatcaatatcgggattatttttgagcaatgtggaggctttgaatgaagtgagtgttttgcctgaacctgtggtatgccaaatatagccgttacctcggttttggtgaatacagtccacaatcgctttgacggcatagatctgatacggtctcatcatcaaaagcttttgttcgcttgctaccaacaccatataatggctgatcattttgcctaacgtgcatttttccaaaaatttatcggcaaaatcatacaagtaattaattttattgtttgcttcatcggcaagacggtataccggtaaaaaacgttcgtctgcatgaaaagcgaaatgtttgttttgattgttggcaaagtaataggtactactctcattgctgacaataaacaattgcataaaacacagtaaactgttgccgtagccgttgcctgtgtcatttttataatcgatgatttgctcaatggctttttggggtggaatttgcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttttcagctcaatttgaacaacaggtataccgttaatcaataaaatcacatcgtagcggtgatggctgttttccgtgttgatacgcaactggctgatcacttcgtagtcgtttttgcaccaatctttgatatttaccagcgtataattgagcggtgtgtcatcttcgcggataaaggtgctagtttcacgcagtctcttagcagcggcaaagacatccggtgtgataatttcaagctttaagcgctcaaattcgctatcggttaaacgaacgcggtttaactgttcaaatttctcacgaaaattttcctccagtgattgtctgtcacaaatatcttctcgaaaaatatactttaaatcttgtaatttctttattagtttattttcgataatggattcagcatagttcatcataagctctatcagttcaagcgaaattttgagaatcttaacacaaacagtaaatctattaaatccatttgagtgtttccttagcaacggttttcgggtgttatttctgttaatgcgtatagtgtattgtaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatagtgtattgtaaggttgtcatatttactgaaattatggaaaatcgacaccaaacgccactgcttgttttatctatccttacctatttcctaaaaaatctaaaatttaacttcttttaaatcaataagttaaatataaatccaaaatcttacatttttgtaagtacttccataaaataagttaaacatctatactgccctcaatttacttacttttaggaagtaaaaatgctgtttatcttattatttatttttagcttaatttttattttcgctattcgcaaaaaaaaacacgcttactgcatttcggtacattccgttttgccaaaacgattacccataatcaacaccgtttttatcttgaagaagtggcgtttgacaatcggcagcaagccattcacggttatttccagcttgctccagccttgcaaaattatggcaaggtgcaggaaacggagtacgatttttttgatttttattcggtggtgctgcggtttgacgactgcacgatgaaactggtgcggtggcaggtttaatgtacaggggcaaacagccaactgctcggctgctttcaccctttgcacgcctgtatcgacaacgccattcactcgcaagcaggcgtgcaacttcgccttgcttgtgctgaattgatggaaaaacaagggcatttgggacccacagggcaagcaaaaatcaccccagcatttaacttgccgtctgcctacgttttgcacactgtggggccgattatcagtggtgcgttatcggcaaaagattgcgaactgctcgccagttgctaccgctcttgcctagaactcgccaagcaacacggtattgagagtgtcgccttttgttgcatcagcacgggcgaatttcgtttccctaatcaagaggcagcagaaatcgccgtgcaaactgtcaaagcctttttagccgataacccgcaaatgaaggtagtgtttaatgtgtttaaagatgtggatttagagatttatcgggggctgttgggggagttgataaaaagtgcggtcaaatttccacaaatttttacaattgcaaaatccataagaaatcccaccgcttgcaattagctatttcttttggcttttcaaaatcccattcaaattctcttccaaccagtccaccaaatccacaaggcgactgccagcctgtaagccaaaatccgtcagcgaatattcaacgtgtggcggaacggtgttgtaggatttacgattgagcataccatcttgttccaactgttgtagcgtttgggtcagcatacgttcgctcacgccgtcaatctcacggcggatttcgctaaaccgttttgtgcctttcatcaacacaatcatcaccaacacgccccaacggttagtcagatgttgcaaaatctcacgagaagggcattgagcggataatacataaccccgttcgattgaatttgaaaatttttccatttttatttccttatatttcaatagattacaaaatatcttcatttcttacatttttgtaagtacttctcaaaagtaagttttaatctataatacgccacatcagccagtttggcaaatcgcattaacttaacaaaggaaaaagcaatgaaaaaatcaaccgcacttttcgtttcagcattagcaatggcaaccgcagcttatgcccaaaatccacaatcaactgtatcaacaaaaggaaacacgacaatgacagcccaagttcaaacaaacaatatccgcaatgcacaagcgttaatcaatattttgtatcgggcgacagtgccaaagcttgcagcttgcttgcaccaaactacattcaacacaatagccaaatcgcagacggcgtatcaggcttaaccgctgcacttgaggcaataggcaaacagggtatcacaatgcaatcgcttttaggtgaagtgcgtcggttaattcccaagccgctttggtaatgtagccttcgatagcgtgggtcaatgcgtccatacctgttgctgccgttaatcctttcggcattgatgacatcatatccggatcgacaacggcaacggctggcacatcgtgaacatctacgcagacgaatttacgttttttctcttcgtcggtaattacatagttgattgtcacttctgctgctgtacctgcggtggttggtacggcaatgattggcacgcattttggtgggttggtgcaacgccttcaagggaaaggacatcgctaaattctgggttgttgatgatgataccgataccttttgcactgtcgataggtgaaccaccaccgattgcaatcatatagtcagcaccagaggctttgaatttttctaccccttttttgatgacacaaacagccaggtttgctttcacttcatcaaaaatttcataaggtaagcctgcttcgtcaagtaagttagtcacttttgctacgacttgataacgcacaagatctttgtcggtgacgattaaagctttggtgaaactacggctttttacttcgtgaacaatgtgttgaattgcacctttgccgtgatagctggtttcgttaaggataagacgatttgccataatgtttttcctcttaaaatttacaagttcaaatacgcacaagggagagggcgtaagcgtaaaattcagaagaaaacagaccgcttgatccctctcgaaatccccctcattcccccttttccaaagggggaagtttgatattccccctctttgaaaaagagggggtagggggagatttttattagtaaagtaccgctttcgcttctggagagtcgatgttttcttttgttacataaactacaccagtatcaataactttctcgactttttcacctttaataattttgccgatagtatcaacacctttgtagcccatttggtatgaagattgcaccacgataccgtctaaagttccgtcacggacgaagttttgaaggtctgagttaccatcaaaaccaacggcaacgattttacctgcgaagcctttttgtttcacagcacgagccatacccactgcggtcggttcgtttgcgccgaagatcgccgcaatatcagggttagaacctaacacgtcttcagtttggttcaatgcggtaaccatttctgaatttgagtagtatgggccgacaattttgtaatctgctttagatttcacttcatcaatgaagccgcctgtacgttcaatcgcagaagctgcaccttgagtgaatgacatcactgccactttaccgcctttcactttagctaataatttttcagcggctaatttaccagctgcacggttatcggttgcaaggaatgattgatagtatttaccatcgctgtttaagcctgagtcgattaataccactggaataccgctttcataggcttttctcacagctggcacaagggctactgggtcagaagccgcaagcacaatacctgcaacaccacggttcacagcgttgtccaccatattgacttgtgcgtcaatcgcagtttctgattcagggccttggaaggtcactttatattttccgcctaaatctgcacctgcagtttctgcacctttacgtacgttttgccagaaagttgagttagcggattttacgatgactgcaatttcgtctgattttgcccacgctaagcctgcaaaaagggtagataaacctaatacagttgtggttacgattgctaattttttcatagttaaatctcctctagagtttatttcttaccaagttttttagattgacggagctggtctaaagacacggctacgataatcaccaaaccgataacaatcatttgcacaaacgatgatacgccattcatattcaaaccattacggagtacaccgataatgaatgacccgattaatgtgccagggatggtaccgacaccgcccatcaacgatgttcccccgactactgcacttgcgattgcatctagctcgtaagccacaccgccgtttggctgtgctgttaccaagcgagaagcaaggattacgcctgttaagccagagagtaagccgctggcaacataggcataaattttgacaacattggttttgataccagataagcgagccgcttcttcatttgaaccgatagcatagatgtagcgacccacttttaatttagttaaggcaaaggtaaagagtactgtgatgaagatcataataatcactggatacggaatacctgcaaacaccacttttggtaaaccatttggaccttcttccacaattttgaataacgcaccgttacctaaggctgcgaaactttccggcatacctgaaactggagcagcgttagtgacatagagtgctaaaccacgagcaaccatcatcataccgagtgtggcgataaatggcggtaatttcatttgggtgactaaaataccattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacaatcattgcagcagcaacccctgaaagggcaactacagaacctgtacttaagtcgataccgcccgttaagataacgcaagttgcaccgataccgattaatgcaatggtcgatgtttgcagaccaacagtcataatgttgttagaggtaaagaaatagtcgttggttacactaaagaaaatgactaagaggattaaccctgccaatgccgccattttgcgaagcagatctttatatttatcactcattttaaagctccttagtttttatattcgtttttgaacatatttctcacgccagtggcatattgcataatctcttcttggttggttttcttggtttccaacatacctgtcattctgccctcacgcattacgataacacggtcggtaatccctaaaatctcaggtaattcagaagaaatcacaatcacaccgacaccattggcggcaagttcatcaattaactgataaatcgcatatttcgccccaacgtcaatgcctcgagttggctcatcaaaaatcatcacatttgcatcacggaacaaccatttgccgataaccactttttgctggttaccaccacttagattattcactaactgctctggtgttggcgttttaatttccattttcttaataaaggtatcgctcgctttcagctcctcattatgtgaaataatgcctaactgatcgcatactttatccattgaagccattgtgatgttctcacgaatagacattctcactgccaccccatttagcttgcggtcttcagataggtaggcgatacctgctttaatcgagtcgcttgggtcacgaataacaactttcttatttcgaacataaatttcgcccccatcaagtggatccgccccaaaaatcgcacgggcaagttctgttcgttttgccccaactaagcctgtaatccccaacacttcgccttttaacaagtcaaagtttaacggctcaaacacgcctttacgttctgcattcatcactgaaagtaataactcatcactgattttggcggtttttggtgggaagtggttatcgagcgtacgccctaccattttggtaatgatttcgtccatcgtaatgtctgagaaacggtggctagacacataagtgccatcacggaaaatggtaatgcggtcgcagatctgttttagttcgtccatacggtgggaaatatagacgatacacacgcctttctctttcaagcggcggacaagctcgaataatttctcaatctctttttcagtgagagcggaagtcggttcgtccataatcaacacttcaacatcaaaagaaagggctttggcaatttccaccatttgctgacgagcaacggaaaggtctttgacaagatcagtcggactcacatcaatatcaaacatattgagcaagtcggcggcatctttattcattttggctttatcaacaatgccaaatttatttggttcacgggcaaagaagatattttctgccacggtaagatgaggaatgaggtttaactcttggaaaatcatactgataccgtctttctgagcttccaacacagaagaataattgacagcttttcctttatagatgatctccccttcatctgcttgataaaccccgatcaagcatttcattaaggtggattttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgattattttatcggctatctctattgagaaaacaaccgtatattcaaacaaaattgaccgaataaaaagaaattttacgaagtaatttagtttttgtgattcagctcacaaaaaaagcaaacgttctcgttttttgactgctcgattttaagaaaagaagaataaatcgggcaaaagatagaacataggatcgggagtagaaaaaaatgaacacaattacggcagtgttgcaatcacggcatagccatccatttcaccaataaaatctacttggctattagcgctgataaaaattgcttcgccttgttgtaaataaatcgagtcatatcctaaatcgacatacaaacttccagacattactaataaaatacttgcacttgttgcagtaaattgttcttcatcaaatggtttaaagctgagtcgctgtaaggcaaagtcctctgcttctggtgttggatataagtgcagtaactcttcactattattttcctcatattgaggaataatcttaggtgtaattgctcgataatcaatcgtatgtagaagtgctgggatatctacatatttaggggttagccctccccgaatgacattatctgaggctgccattagttcaatattttgtcctcgcaaataggcgtgaggtaagcctgcgccttgataaattccctctccctttttgagatttacaatattaaatagatagaaacagagaagccctgcatctagtttatccagacttattttcattgcatcaatagtatatagtacccaatagtcaggatcgtctagtttaagtctatcttgttgataatcctcttgtttattttcaatgatgggcaataaccattctgcaagctgagtttgttctgcttgcataatggaggcataaaccgttggtaaactttgtttttcaatcgctttcgccagaccttgtaaagattgatgcttcattaggctttctttaatcgcatcttcagatttaaacccgtgtaatagccaaaagtctgataatgcaatcatcatttctggtttatgattacgatctttataggtgcggtttgaggcatttagtggaataccttcataattttcacgttcaaaaccgtgttctgcctcttttttagttgggtgaagttgaatcgaaagcggtaacttcacatccaaaattttcagtaagaaaggtaattcatctccaaattgttcacgcgatttttctcctagtatttgaggcgccttatctaaaacgcgatctaaaggcaaccatgctccttcaaattcaatcattgaaggagcagaacggtgtgctccaagccaatattctgcatagggtttctcttcgtgagtgtcaagttttaaccagttgggtatgaaaatatctccaccccaatcataatgttgatgtttacccactaatttgaaaatcattttttgtatcctccaaagaaattgacaactcgttcaatatcttctttttgtttaatccgaataaacaatcgcctattattttttagatcaatgactaaaatattctgatctgccaaattaatttgtgcaatatggctatataaaaaatagaaattgccaaagaaaaagccttgttcttttaatagtaaacgagggtaacgaatgaacgccgaatagactgctaagacaatacaaccgcacaataagaatacagtgagaggttcaatacctgtttgtacgccctgcacgataattaacacaattagggcaattaaaatccctgtgtctaaacttgcttgtcgaactaacggcacgcttaatcgagtttcgccgtttcgtctgtccataatgagctgatcatagagaatatagagcaagctcaaaccaatagctaaaatcagaagtatatttgtcatttgtagaatgttcttaaaaaaagaccgcttgtattttagcacaagcggtctaatttatcggattttttgcaaattatgcaagaatacctgtccacgcaccgaagataccgataacgaagaagccaacgataatccaaagtgcattcacacggttacgtaataaccacatacacgcaaatgttaaaagtaacggtaataagcccggcattaagctatctaagatagattgaacggtggtaatttccgttgtgccgtcttgtttttgaatagtagaaactacaagcggtacattaatgcttgtccatttctgaaccaacgctcccataataaacaagccgagaattgatgcaccttcggttaatttttgtaataaaccgccgctcatatcttgtacaacatttaagccttttttgtaaccataaacgacgccgtagtaacgggttgctaaacgcacaaggttaaataatacgaagaatagtagtggacctaataagctacctgttaaggcaacgcctgcacctaatgctgcaaatactggacgagctgtcccccaataaatcgggtcgcccacaccagcaagaggccccatcaaaccaactttgatcccgttgattgccgcatcatcaataggtttaccattcgcacgctcttcttccattgcgatagttacccctaatacaggagccgctacgaatggttgagtattaaagaactcaaggtgacgtttgatcgcatctttacgttcttgtgagtttggatctggatataaacgtttgataacaggcaccattgagtaggcgaaacctaacgcctgcatacgctcgaagttccaagaaccttggaagagattagaacggcgtaccaccgcattcaaatcgccctgtgttacttttttgatttcagttgtcatagtcttacttccttagtctaatctgttgtcaaggtcgttgtttgttgcttgcacttgcaccacttgtttactttggttgtatttcgggtgaagttggatataaataatcgcagtgatagtacctaaaacccctaatgctacaaggttgaaatcggtaaatgctgcaattacgaaacccgcgtagaagaatggcattaagtgacctgcacgcatcatattgataaccatcgcataacctacaaccgcgataaagccaccggcaattttaagacctgttgttacaactggcggaatggctgctaacatagattgaacactatctgtacctgctgtcatcgcaacgattaacgctgggattgcaatacgcattgcttgaagtaataacgctgaacggtggatccaatccagcttatttaagtctcctgtttcaatcgctttatctgctgcgtgttggaaaccgactgtaatcgcacgtacaacataagttaaaacttggcctgccgcagcaagtggaatggcgagtgcaatcgctgtcgggatatcttgtccgctcacgataactaagatggttgaaaccactgatgctaatgccgcatctggtgctaatgccgcaccgatattcatccaacctaacgctaataattctaatgaaccaccaacaatgatccccgttttcatatcacctaatacgataccgattaaggtacaagcgattaacggacggtgagtttgccactcatcaaggattgatcccatacctgaaatacaggcgacaaggaatactaagataatttgtaatgtagaaatttccataataatttccttagattaagttatttttcttgagtaaatccatcatatattgacggctatcgttcgatactttacgcacatcaagttcaatacccttcgcatctaatactttaaatgcttcgatatctttatcatcaacagcaacggcactggtaatcattttcttaccatctttatatgccataccgccgatattgatcgatttgaactcaacacctgcttccattaaacgcaccacgtctgtcggattagtgaaaagtaacatcatacgttcattcgcatattcagggttgttgtaaacacggatcatcttatccacaggtacaacatgagccgtcactcctggtggtgctacactttttagcatcgttgaacgcacactatcttttgccacatcatcgttcactaccacaatacggctaacacggctctctttcgtccagcgagtcgccacttgaccgtgaattaaacggtcgtcaatacgcgctagaccaatcactaaattcccttcttgattgacttgagctacttgtggttgtactggagcttgagcagcagtagcaggttgtaccgcaggtgcttcttctttctcctgatagcgtaatgcacgcacgcctaaacgtcctgtttcaagagcgacttccactaattctgataaagacggaccatcatcacgtgccataaaggtttcaacgagcatcggcacgtttacacctgtgacgatatccatattctctttgccttcagacacacggtttgccgcattaaacggactaccgccccaagtatcaacaaggaatagcacctgatcgcagtgagcgagctcattcgctaatttctcttgatatttacccataatagtttcggcattttcaccaggtacaaagtcgatagtggctacatcactttgttccccgattaacatctctgtggttttgagaagttgttctgcggcgacaccgtgggttgctatgataatagcaatactcattggttgctccttatgtgaggatttattcggattattaaaacttattctcaatagagtaaatttcggagtggaattttaaaggatgccgatttttcagcaatctgatttatataaaaatgtgatctacttctcatttttgagttaggtaagagggttatttgctgattttatgagcttatttttttattataaaaaataattatctaatttgactatggagatataaaaatgtctgtatcttatagttgtcacttcagatacagacacagattgtagttagggggatacttcaccatctatcaaacaaattaacagatatattctcagtctagctttgactcaatcaacttaactaaaaagctaatatgatcgctatttgcattcaatgctgaaatatatctgtagttatttcctcctgcatttttaaaattttcctgattttcttcagcaatttcttcaattgtttcaaggcaatctgcggcaaaaccaggacaaataaccgctatgttttttatatttttagtaggaagattcgataaaagttcatcggtataaggttgaagccactcttcactaccaaaacgagattggaaagataaaagccattgattttctgtcaaattgagctccttggctactaaacgggcagtttctcggcattgttctgaataaaagtcaccttctgcttcataacgagcaggtataccgtggaaagaaaaaagtaatagctcattctctgtaagcgttacagtatttgctaatgctttaatatacaaagggtgattatggtaattgtgaataaattcaaaaggcaaaactttcttgtgtttatataatgcttgtgcaaaagcatccagcactgaggctgttgttgttgagctatattgagggtagagtggaagtataataattttttctacatcctgtgctataaggctatcaacagcactctggatactaggattaccgtaactcattccaagttcaatgacaatattgttgttctgtgagcaaaaataagtctgaatagcggcttgctgttgacgagatatagataataaaggagagccatcttctgtccagatagttttataagcctgtgcaactttaggtactcttttaggtaacacaagacagttcaaaataaatttccaacgccacttcggtaaatcaattactcttggatcgctcaggaattgtcttaagtaacgtttcactgccggagtagttggttcatcaggagtgcctaagtttgctaatagcacaccaattttttttgatttattcatagaaatccttcatgggtaattagttatagacgtattatagagtattagcaacatcaatactatttatcaaactaacaggcaaaaatataaatagatattatatttgtcagatttatctctatagtgaaatacagaagacatattagtgcttgctttatgctactgtttaagaaaaatacaaccaataaagtgattattagataaactgtccttgtattaagttttaatgctcatatacattaaactgaaccatgattccattctgtcagagattgttgttagatctaacgcttcagattgttcagtgatacgagtcagatagggatttttatttatatcaaaaatcttttttaagatttttgatggatccaattctttattcttgttattaaagtattctgtaatactatcactaagtgcccattttaattctgtttggcttgccaaataatcttgtaaataaagatttaatatctccgttgcttctgtttgcgaaatatcattaaaggttaggtaatttgctttttcaccttgtcgataataaaaacgtagcgaaagaatagggtgattatttgcttttaataacaaataataaatccacgcttgaataatatctttatctcgcaatccccctactcgccataataccacttcattattaaagcaatttggaacattacctacaagttgatattttctctctgcaaaaataacagagtgttctatttcaataacgtttttctcttgcgacaaataagaagataacgtatttcttaaaagctgaatatcttcggtgagttttgttttattaatctctgcaaaataacgagcgggtagattgccttttaatttttcattctcaaaaaagatttcaatatcttgttcttcgacttgaattaaatcatcaagtaaattatatttttctaagccagacaatttgaaaatttcactttcttcaattttgtcttcattctgctcaaaacgaacccctaattgttgttggaagaaatattttattggttcttgaatataatgaataaactggttaagtggaatatctgacattatatcttcctgcgttttagttaatttctgcaagaaatctttgcgtggtaaaatattatttttaacttccagccactctttatcataagccactttgccatctttgaaattatttgggctaaatacggtcattgggtgaacagacaataatttagtatagtcagctttaggcaggttttctttcaaataatcaaataattgtgtcaccaacaccgatggtaatttttcttggctacttgtgagcgattgcccaatataactgatatagagcatttgttgagccgagagcaaggcttcaaggaaaagataacgatcatcatctcgtcttgagcggtcgcctttttgtggggcgtactgcattaaatcaaaactattgatcgtctgttggcgtggaaactcaccttcattcatacccaacaaacagactactttgaaaggaattgctcgcatcggtaataacgtacagaaattcaccttacccacaaggaaatttaagtggctacgctgttcgctcagttgttgagtaaatagctcaagcatcacatcaatacctatcgcttcttcaaaatggctttgctgaatttgctcaatcacatcacggatagcctgctgtaacgtcaaaatcgcatcaatactttgatcgttttcttgataggtctgtgccacaagggtaaacagctgttcttgccaagcagataggctctgtggctggcaaataaaggcgtgccaagcggtgagattgtcgataaattttgctaaattccctgttaattcagagattaatccataactttcatcaaaagctaaaatgttctgccagccattattttccgcttttaaacttgtgcctaacaataatcggtttagcccattttcccacgaattataattttgccattctgggttctctatttttaagccagatctaatgccaaccgatttaatccattctcttaatgtattaattttctgctcattaaattgatatttttctcgaatagctgaaatatcaaagagatctaatatctcttctgctgagaatttattttctttaatcgataacaattgtaaaaagctagcaataattggattaatataactaattttttgatctgataaggtaaagggaatatatcttctctctttttcataacgagaaaataccgcattaatataaggtgcataactatcaatatccgcagacatcacaataatatctttcggggataagtcaggataggtttcaaataaatataataattgattatataatacttctacttcacgcattttgctgtggcaagtgtgaagctgaatagagcgatcttcattagctaaagagaatgtagtttggtgttctgaatataaaatcgctttttttacttgggttaataatgtcggatttttatcttcaaaatgattataaagtgatatatcttgaatacctgtttcagttaataaatttaaaaattcttttccttgttttccccaaactgttaataatgggtttccttgtttttcaaataactctgctaattctgcttcagataaattatcttttaacgctaatttttctaataccttatcttcacgatcatttgcccagtattccatacttggattagtgaaaaagaggtgaacattgcaatgctcactcaattttttcaatacggcgagctgagaatggggaagggaagaaatgccaaacataaaaatccgtttcggtaagcgagctttttcagtggcagttaaattatcaagtttatcgaaataacgctgttgcaaataagcacggtgtgaagtattaaaaatcgcttcatcgctatcctgttttatatcggcaaccaacgcattccaaaggatactttgccacgccacattcgttgcaatctcttttgcatttttttgcttaaaagaaaccgctcgcataatctcatcaaccaccgcttgcgattgccccttttcccatagcaccaaccattgcggacggtacacgagatattggtcaaacagatcggagattttctctgctaattgatactgttttagctgatcgccttggtttaaataggacgcaagtgcttcaaaggcaggttgttcaaggaactgcggaataattcgcattaaacgccacaacattgactggcgctcaaagctattctctttcggcaaatcaggaaaaagcacgcgatattgttgccataaaaaactggttgggtaaggaaattgcacattaccagccaccccgatttcttgagcaatctgcatttgcaaccattgtgccatacctaaactttgtaccagcacaatctcttgactaaatggatcggggttgggatctttcgctaagatcgcagtcaatagatttttctgttcggttatttggtttgaataatatactctaaacatagcaactcccctttgtaagcaagctattttagcgagtttggggggaatgatctatttggcaacctaatttataattagaattatagtgatgttattatctatcatataattcccaacgcatatttcaacgcccgttttttcaacggcgttgcacgttccgccacaattaacgcaacattacgcgcgactttcacaggtaataaatctgtcttaaaggttttataaaatacgtccattcccgtttgcattaacagattatcaggcttacgttttcgttcgtaaccatttaacaccgcttcatctgcaaaattctgccctttttcgaccgcttgttctatcacttcaagtaaggcttttacatctttaaaaccaagattcaccccctgccctgccagtggattaatcgtatgagcagaatccccgactaagacaatcccatttcgcacatagctttgggcgtgctgacgtgtgagtgggaaactatcgtgagcggtcacttcaaccttgcctaaacggcttggaaaatggcgctgaatctctgcactcaatttctctttgctcatctgttgcagttgagcaatacgttgtggcgaatcataccaaaccacacaaccgttatgttccagtaacggtagaaaagctcttggaccgctttcaaagaactgttgccaagtgacactctgttgcggtaattctgttttgactacggcaagcagacagtgttggcgatattgccagcttgtcaaaccaatgcccgaccagcgacgcacaagggaatttgcgccatcacaggcaatcaatagcgcggaaaacacctgctgatcaagctcaacagtccaaacaccgttctcatcacgacttacagaaatttgctcaaaaccaaccgcttgctgacagtttggatactgtgccaacgcttgccaaagcccaagctgaataaggttgttttccaccatataacccaacttatctaagccaagatcatttgcatgaaaagcggtattaaagccatcaatttcccacgtttctaagccgtcataaggacaaactcgcatcgcttcaatcgcctgccacgcccctaatttctccaacaacgcaacggaagccacactaattgccgaaattcgcacatcataaggtgcatttggatcaaatgccggcaacggatttttctcaatcagaacaacctttagccctagctttgccagccctaatgctgtcgccgccccgaccattccaccgccaattacaatcacatcttgttgagtcatcgtcattttcctctcaaatttgttaggcagaagtttactacaagcggtgagatcttcattgatttttgcaaaatttttgtgacactcgtcgaaaaatgattttctctcacttgtctttttgtcataaaaattaacaatctcttgattacttcactatatgaagtttgcttgttattttgtattgaaaacattacaatcatagaaaatcaattatgtacattattgaacaaactgaaacctttaaattatggctaaatgaactcaaagatcctattgcaaaaattgcgattatccgtcgcttagaacgagcaaaaaacggacattttggagatcataagtcgctaggtgacggcatttatgaaatgcgattgatgataaacaaaggctaccgtatctactatgcaagaaaaggggaaatcatctatctcattatcaacggcggatacaaagacagccaagagcaggacatcgccgtagcaaaaatattctggcaacaataccaacttgaacaggaataaaatcagatgaaagataaatcgtttaacggacaaatatcaacgttcgatgctgctgagtatctcaataacgatgaacttatcgcactttatctatcggaagtgctaaaagacggtgatgaagccgaattcattcaagcgttaaataccattgctcgtgcaaaaggaatgaatgaattagccaaaaaagccaatatcggtagagaaagtttatatcaaacactttcaagcaaaaaaccacgttttgaaaccattgtgaaaattctttcagcgttaaatattgagctagtgcctaaggttaaaactacccaatagcttttatcttttcactatttttgtgacactcgtcgaaaaaccacaatattaaaattgcgttccctgtaaccatctcacaataatatgatttcatcacatacattgacttcattatttgaagtcataaaatagggaaatcaaatgcgaaagaaacatcagcaaacactttatgctattttcgcaacaccaacatcatctaatatcaaatggaaagagatagaatctctgattgaagggttaggtggtgagattattcaaggtgaaggctctagagtacgatttaaactaaacaatagcattgctcgttttcatcgtccacacccatcaccagatacagataagggtgctatcgcaaacttgcgtgaatggcttactaaaataggaattactccaaatggcaacaaaacaacaacctaatattatctatattgatcattatcctgctattgtcagctatatacctgaattgaagatgtttcgtgggaaatttctcaatacgacgggatattgtgatttcattgccgatagcgtagttggtttatatcaagaaggaaaaatctctctagatgaatatctagtagactgccgtgaaaacggtattgttgcatttgagcaagaaaagcaaaaaacctttacattacgctatgatgaaactctatcagaacttgttactcaacaggctaaagcacgtggaatttcaattaatcacttgatcattgaagctattgagcaacatttagcacaacgactttaactatttttgtgacactcgtcgaaaaaccaacattttttgctattcaaagatacacatactttttacgctaatataaaaaaggaaaaaagtatgtctttagcgattatttacagccgagcatctatcggcgttgaagccccattagtaaccattgaagtgcatatcagtggcggaagccctggacttaccctagttggattgcccgaaaaaagcgtcaaagaagcacaagatagggtgcgaagtgctttgatgaatgccaattttgattaccctgccagacgtattactatcaaccttgcccctgccgatctccccaaagaaggcggacgttttgatttacccattgccatcgggattttggcagcatcagggcaaattgacagcgataaactcaaacggattgaactgcttggagagctgtctttgacaggacatttgcgtggggttcacggtgcaattcctgcggtgttggcagcaagtaaagcgaaacgggaaattattgtgccacaacaaaacgccaatgaagtttccttggtttcaaatacccaaacctattgtgcttcaaccttgttacaggttgtcaattttctcaacaatcgagatcaactgccgattgctcagcagctttcgcaaaatattgccgaaaacagaccgcttgtcagccgtgatttaaccgatattatcgggcaacaacacgccaaacgagcattgattattgccgctagcggtcagcataatctgttgtttttaggtccacctggtacaggcaaaacaatgcttgctagtcgccttgccgatctgctgcctgaaatggaagatgatgaagcaattgaaacagcatctgtcaccagtcttgtacaaaatgaactcaactttcagaactggaaaaaacgcccgtttcgttccccacatcacagtgcatcaatggttgcgttggttgggggcggttcgatcccgaaaccaggggaaatttcactggcacacaacggcgtgctgtttttagacgaattgcctgaatttgaacggaaagtgttagatgcattacgccagccgttggagtcgggagaaatcattatttccagagccaatgccaaggtgcagtttcctgcttgttttcaactgattgccgcaatgaacccaagcccgacagggcattatcaaggaacgcacaatcgaacgtcaccacaacagttaatgcgttatctcaaccgtttatcagggccttttctcgaccgcttcgatctctcgattgaagtgccgttactgccacaaggtgcattgcaaaataacaccgatcaacgtggcgaaactaccgaacaggctcgcaagcgggtacttgaagcaagacatttgcaatttaaccgtcgggggaaaatcaatgctcaactgacgaccaaagagattgaacaagattgcaaactgactgatcgagatgcgttatttttagaaaatgccttaacgaaattaggtttgtcagtgcgagcttatcaccgtattctcaaagtttctcgcaccattgctgacttggctggagaagcccaaatccaacagccccatctggctgaagctttgggctatcgggcaatggatcgtttgttacaaaggttacaaggggaaagttagttctcaaaaacctctaacaccaacttactcaaacagtccaacaacatcaactcttgattgaccgcattgacttcgcgtaaatcccgttgggtttgttgaataatttgatgccctttcagtaaaccttgagcagtcagctgttggctaaaaggcagaataccgttttgcagatcaggattgagccaacctgttgcgatttgcattttggctttcagggcatcgctgaaaaacgaacccagccattcaagctgttgtagcacttgctcaggctctttgtcaaaagcagaaaagagcaagaaaacatctcggcttttgtaaaaacgccaaaaggtctgcaaaaaggttttacggcttggtaagcggtcagtttcaaggaacgttttgcaaagcaatgggcggttgtggcatagacgaagtgcggtttcaatctcacttggctgtgctgtcgggcatttcgtctgtaaccattcaaatgtttgtgacggctcaggcgtatgaactaaccacgtctggcaacggctttgaatagtggcaagcattgtgacttgcaaaggggcttccaataagaaatagacattttggttcggctcttcaagggttttcagtaacgcattcgccgctgcttccgttaaacgttccgctccagccagataaactacggcatttccgccttgttgagcaaactgttgtaatttggcagtgatttctcgcacttgatcgatcccaatatctttatcatcaatcggggctaacaggtgaaaatcagggtgattgccgctctgccataacaaacagcttttgcattgtccgcaaggttggctctgttgtggcgtatggcaaagcaaccaatgggcaaaatggcgaataagttgctctgtacctagcccactgtctgttttaaacaataaggcgtgatgcccccgaccttgtagaaaagtcgaagtgatttggtggtgggtttgtttatgccaagggtaaaggttcatattcattcaacaaattaccagctaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctaataaaactaaatatgctcttatttttcattcgtttcattactccctcactttgcctttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtaaaaccgaagagaagaagataaaaacttaccaaatcattttgtcaataatctgaaaagatgtatatacccctttcgtaaatatattatatttacacattcaaaacaatcttcagattatttctctgatgttaaaaatatttccaccgcttgttgaatatccgccgacacctgttctatcgcaggttcagcgttaatgagcaccgctttcggattatctttgactaaggatacataacgctcacgggtacggtgaaaaaagtcgatatcgagttgctcaatacgatctaacgctccacgccctcttgctcgctctaaacctatcgatggctcaatatcaaggtagatcgtaaaatcaggctcaaaatcacctaaaatcaccgaacctacctcatccaccaattccgctaatccccgtccaccgccttgataggcttggctcgacatattgtggcgatcgccaacaacccatttgcctgaagctaaagctggttcaatcaccgtttccactaactgtatacgagccgcataaatcatcaatacttccgctttgtcggttgtatgctcgccgtcttcgccttctttccatagattgcgaagtgcttcggcaatcggagttccgcctggttcacgagtggtaataaattcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccattctcgcaccgctttattatgctcatctaaagtacggctgaatttatgcccaccagaaccgtccgccacaaaatagaaataaggcgtactgtcaggctgtgccgtcgccttaattgacgcttcgctcggcattgcaatcggtgtcggcggcaaaccatcaatcacataagtattataaggagtaggttcaagcagatctttcttacggatattgccatcatatttatcgcccataccgtaaatgaccgttggatcggcctgcaatttccagccatttttcaagcggttgataaataccgatgccacttgcggacgctcattcgccacgcccgtttctttttcgacaatcgaagccaaaattagcatttcataaggcgttttaagcggtaggttttctgccctattttgccaagcctgttccaacgccttttgctgtttttgataggcacgtttaagcacatcaatatctttggaataaggcacatagctataagtatcaggggcaagccaaccttccaatttatcctgagtgattcccaatagtttagcaatgtcagcctctgttttatccgtcaaagtttgttctaaatagcgagcctttgccaactgctcacgccacgttttaaaggtttttccttcaataaattgcacatttaactgcacttctttaccgctattgaaatgttgcaacagctctttcaccgtagcgatattatctaacgcataaaccccagccttaaatttactgagtttagggttaaggcggatcaaatagggtaatagctccacatcatcacgatgaataatgccttgctctgctaatagctgagcgagtttttggcttgatgtacctttttccaacacaaacagttgctcaggtttaacggttaatttatgttctgctaactgattgagtttttggtaaacataaacgccaccacctagggcaaccgcagataaaagcccgagagaaataagaattttttttaacatggttaggaagttttaatcaaaagaaaaacnnnnnnaaccttactataagggatagtaaaaagctatgacaagcggtaagattttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgttgcgtaacgagggcgtatcatacggattttacgttggagatcaaccctttttttatatttttaacttatttgcatagtttacaagcaaataatatcaacaagcggtgagattctgtaaaaattttaccaaatctaaccgcttgtctttaagcgaaaaaaattacgctttcgctttttctgctgcttttacgatcaccgcaaatgcaggcgctttaagtgacgcaccgcccactaacgcaccatcaatgtctggctgagtaaataattctgctgcattcgcatcattgactgaaccgccgtattgaatgatcacttgatctgccacggcttgtgactgttttgcaatgtgaccacgaatgaaagcgtgaactgcttgcgcctgtgctggggttgcagatttacctgtaccgattgcccaaactggttcgtacgcaattactgcaccattgaatgcttctgcacctaaagtatttaatactgcatctaattgacgagcacatactgcttcggtttgaccagcttcattttctgcttcagtttcaccgatacataacactggcactaaacctgcttcttttaatgctgcaaattttttcgcaataaattcatcgctctctttgtggtaagtacgacgctcagagtgaccgataatgatatatttcgcaccgaaatcttttaacattgcagttgaaatatcacctgtaaatgcaccttgtacattcacatcaacgttttgagcgcctaatgcaatgagtttcttcgtggtgcattcacaaccacagctcgccaatgccgcttctgcttctgccaaatacattactggcggtgcgattgcgacatcacaacctgtaacaccatcaagttctctttttaagctttccactaattctttagtgaatgctttgctaccgtttaatttccagttacccattactaacggacgacgtgccattttgtttctcctattgagtgaaatgtaaaataaaaacgtgcgaactataccaaatttcacagaaaatttattgtttttccgcaagatttcagctcaatatttaaaaataactgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttaatatgagcaaaaaattgtagtggaacatcaagatctactggcattaatggcaaaagaacgaatgaacgccgctcgccgtgcgatgttctgtaaaccacaacactttgaatggctatttgaagaggaaggtttacggttgaaattctttttagatgctggcagttatgccacagcgttggtgagagaattagtacagctcgaagaataactaaactttccccctttgaaaaaggggggaattaaaactataaggaaataaatcacaatgaatatactattaagcaatgacgatggctttcacgcccacggtattcaatttttagcgaaagcattaagagaagcaggacataaagtaaccattgttgcccctgatcgcaatcgcagtgcggcatcaagctgtttaacactggttgatccgcttcgtgtgcataaatttgagaatggtgattatacggtgattgcaggtacgcctgccgattgtgttcatcttgcattaaatggtttacttgatgagccgtttgacttggtggtatcagggattaatcacggggcaaatttaggtgatgatgtggtctattcgggaaccgttgctgcggctcttgaaggtcgtcacttaccgttgccatcagtggcggtgtctttagtgggttctcacggttcaacctatttaacaggcaaatgccatttcgatacggctgcacaagtggtggttgaactattgccgaaaatcacggcaaatcttattcctgcaaatcaagtgttaaatgtgaatgtgccaaatgttccttatcacgagttgcaaggtattcaaattactcggttaggtgatcgttctcctgcggctgagattattaagcaacaagatccgcgtggggcaaatgtgtattggattggggcaagcggtaagccgactgatgaaagcgaaggcactgatttttatgcgatcaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttatgcgatcaaccataactttgtgtctatcacccctattcaaccagatatgactgcatatttgtcaatttcacgtttaaatgagactttttaaatgaaactttttggaacaatttatgataaaacgatggaatggtcaaaacatcgctttgctgcaggctggttaagttttgtcagttttattgaagcgactttcttccctattccgcctgatgtgatgctaattcctatgtcgatgagtaaaccacagatggcaacacgttatgcgatttatactacgcttgcatcagttttaggtggtatcattggttactttatcggcttatatgcatttgattgggtaaaagggattattacagactggggaatgcaagcaagttttgatcaagccatggattggtttgaaacttggggagtagcaatcgtctttttagcaggcttctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctttttagcaggcttctcgccaattccgtttaaagtatttactatttgtgcaggtgtattgcagatgtcttttttaccctttattttgaccgctgcaatttctcgttttgctcgcttcattcttgtggcaaaattatcagcttggggcggtgagaaatacgccgataagatccgtcgctcaatagaattaattggttggggaacagtgtctattgccgttgctgcctatgttatttataccttattaaaataagaggctattatgaaaaaatcgtttcttttacttccgcttgcagcagtagtgttagctgcgtgttcatcagatacatcgtcagaaacctcgcctaatgttgaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacctcgcctaatgttgaagtaacagaggctggatctgcgtggcaaaccgaagttcaacaagtgggtatgccaagctcaatgacacagccaacttatcagcctcaaccaacttatactccgccaccagcaccgcagccgacctatcagcctgcaccacaaccgacttatagccaaccaagcaatgttcaaacgaactacggcggtcaaagtgaagtggtcggaagttgtaatgtggtaagagatggaagtaatgctccgatttatagccaaattcagaaaggttgctatacagacagcacttataccgttgacaaacacgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacgctctttttagtggcttatttgactgggcaaacacctaatcaaattgctgctttaaataatttgagtacagcaacgccattgaaagtaggtcaagtacttagagtaaaatagttttatttgtaatgacatttgaatagacgcagaggttgcgtctattacgatattgagcagacgctgtagcgttttagacttttttgaacgccctttggcgttttcattttctttgaaggataattgaatgaaaaaatcgtttttcttattaccgcttgcagcattagttttgactgcctgcggttcaaatacgcctgcacctgtggtaaatgcggaaggttctgatttatcacctggcgtaatgcaacctattggtatgggggcaaacaatactaattacggctggcagacagatgtgcaaagcacttctatgccaagcacgatggcacaaccaacttatacacaaccgccagtgcctcagcctgtgtatcaagctccgcagccaacttatcaagcacctcaacccgtgcatcaagttgttcctcagccaataacaaagccgacagctaaaacaacacccgtagcgaaaaagcctgtatcacaagattttactattcctcgtgacgctaacaatgcacctatttatagtcaaattgataaaggcttctataatggcgatagctacactgtccgcaaaggcgatacgatgttcctcatcgcatacattgcaggtaaagatgttaaggaagtcgctgctttgaacaatatgagcgagccttatcaacttggtgtagggcaggttttaaaattgggtaatactcaacctattgaaccaaaacaacaaactgttcagtcaccaaaacctgcaccaaccccagtagaacctgtagtaacttatacccaagcaccgaacggcactgcttatggctcagatggtacaatgactggtcctgtgaaagcgagtgtaggaactgttccacctgctcaaacttctacaaccccaagagtaaccgcaactgcggctaacaataccccgaactacagctcaacatctgtaccagcagtggcatcgtcaattcgctggcagtggccgacgcaagggcgtgtaatttctggtttctctgcatctgaagggggcaataaaggtttagatattgcaggaacgaaagggcaaccagtaaaagcggctgcggcaggtcgagtagtttatgcaggtaacgcactacaaggttacggcaacttaattatcatcaaacataatgatgacttcttgagtgcctatgctcacaacgatagtatcaaagtggaagaacaagataatgttaaagctggcgaaaccattgcgactttaggtagcacagggacaaacagcaacaaactgcatttcgagatccgctatcaaggtaagtcggtagatcctgctcgctacttgccaagacagtaattatgataatttgaggcatagtagacaaaagtgttggtttttctgcaaactatgtctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaccctrcgggtccaactggaaattcggaattaaaaggcattacgtcgatwgccaatggtaacgacgccaccaaggcgaatggggctaagattaccttgtctgcagrttctacarataaaacagttaatgttaatgatgcgaaaattaccaatgtggcggctggtryagcagatacygatgcggtraatgtgaaacagttgaaatctgcgaaaactgaagtggaatctaccgatcacagtgtggtgattaaagagcgtcagggcgataatcagcaaatcgtgtatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatagtacattcagacacaggtattttttataatgaatgaaaagtggggaaaaacggctaaaattcactaaaataaaggtccttagcgattaagatcattgaaaatttactgcggttaatattgcattttgtttttttattcaactgctacataatgccgctataagagactttaagccactttttagtggctattttatattactcccattccgatacatgcaaaggaaaatacaagaattattctatatcctctgattgtaaatccagcaactctggcgataacacaatccctgttaaatccgcatagacataatcttcaggcaaaaaggtcactccgccaaaattaacaggggtatcaacttcacccaccattgagccatcagctccaacaggaattggggcgagggcttgaataccaatatctaaggtttctaatacatctaattgacgtactgcaccattgacaataataccttcccagccattatccacggcaagttgggcgagttctgcatcaattaatgctcgacgcactacgccaccaccatcgactaaaagcactcgtccttgaccttcttcttccaacacttctgcaattaagccattgctttcaaagcattttactgtggtgattttgccgtagaaagatgaaagtccgccaaagctagaaaaaataggttcgacgacatcaacctgatcggaataaatatcacaaagttcagaagtatcaacacgcataacttgctccttttttcaattttattggtggaagtataaacctttgcaaaattttgttcaaatctaaccgcttgactgggttgtattatgctctcgatgtatccgccataacattctggcatcaatgtttgatgatgaaatcattgttagaaaaacggctgccccaaaatagaaagcggcttcgcccaccgagaagctgataatttgccctcgttcaaccaaagacatcatcaatgcaaggacaaacaagtctaacattgaccagcgtccgacaaagtgaacatagtgtagtagtttcatctgccagtgaattgggtgtttccagcggtaatggatcgcaagcaacaagtagaaaatcacggcaactttattaaacggcacggcaatactagcaataaagataatggctgcaattaagtaactgcccatttccataaataaaatcaccccgcccatcagtgtatctgcggaagttgccccagcaaattcggtcgatgaaatcggcaaaaggttggcagggatcatcatcactgccccagcaatcaaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcatattcacgcactttaaatgccgccacggcaatcgccacgagataaacatctaacatcacccactgtttcgctttgctgagtaaaatcaaggtgtaacgtggtctgtggcggattagccgttgaatgaagatcaacaataccaagcctgcaaaggcaaaaggcattatcaccgaacagagcaaaatcataaatgccgtgtaggggaagccttccgtcgccattttccatacgccaccccaaacggacgcataaatcggcacgcctagtaggtcgatattcatcaacggcaaccataagccaaaaggcaataaaataagaatagataaggcgataatggcacaacgtcgcaagctccaacggttaccagattgcaatacttcattgcaattcgggcaacaagcggtctgattgggtagatcttttgctatgctgacaacgctatcacattcaaggcatcgctgtaagtaaatctcgtcttttttcattctttggttaatcgttgtgcaacaggggcaaaactcttacggtgataaggggttacgcccaagctttctaatttttcaaaatgtagcttggttgggtagcctttatgctgtgcaaagccgtactcaggatactgtttatcgagttcgtccatttcctgatcccgtgccactttggctaaaatagatgcagcactgatttcagcaacaagactatcacctttcacgaccgcttgtgctggcataggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcttgtgctggcataggcaaggttggaatacgatttccgtccactaacacaaaatcaggctgaatacgaagccctgcaaccgctcgttgcattgccaacattgtggcgtgcaaaatattcagttggtcgatttcatcaggctctgctcgccctaaagaccaacacaatgccttcgctttaatttcttccgccaacgtaagacggcgtttttccgagagtttcttcgagtcggcaagcccttcaatcggctgattaggatcaagaataacggcagccgttaccaccgctccaaccaaaggcccacgcccgacttcatctacccctgcaatgagctttgcttttggatattcaaacatcaattttcttccaagctataaggcagttcaaataatgccaagctgacattgccgacacggaaattagcttctggctcaagttctttattcagcactacttgtagccaaagctgttgttgataacgctggaccgctaaaattgtcccagtgtttttccagttctcgcccaactgcatttcaatgctagaggcgatcgctggcagttcgatctcaccttccacattacccacaaaggtaaacatcgcccgtttatttgccccacgatatttcgcacgagccaccgtttcctgcccgatatagcaccctttggtaaaggaaatggctttatcaagtagttgcagattggttgcctgtggaattagctcaaactgattagccttgtagagtaatggcacgccctgctgaatatcaatcagattccacaaacgactatcgccattggtttccaccacaatatcgccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagatcgcccgtttaggctcttcgtcaaggtaacaagcggtcacattctcgttaaattttgcaatgatctcaccgcttgtcgttccaaacagagcctgatctaattcggtaaaggtcactttggaaaacaccgcatatttcttcaactgcaccagtgcctcaggcaacagatcttgttgaataatcaggaaaaattgctccgccgttgcacgatataaacggaacaacgcactcatttttcctttcggatcacaatggcaagttaagctctgctcaccaacagcaagtttcgctacatcacaagtaagctgtccttgcagatatttttccgcatcaatcccagctacttcaatcaagcgatattgagttaaagccacacacaattcaggctgttgatgtgtcactttttgacattcacatttcatcttattatctcaaaatagggttaaaaacaggcggatcatacacgatttgcccgatgggataaattgatttgctgggggaaatttgttactccaagctttcccccaaataatcagcacaatcaaggcgtaagcgagcgcagaaaccagctgcccatttagcaccgcatttaccgcaaaactgcccaccaaaggataaatcaacaacagcagattttccgccgccaccaagccgaatgtggcgaacagccgttttttatgttgcaaagcaagggttttgagcgaacggaacattgttggttcgaggggtggctcaaaggtcggttcaagatttgctaaggacatcaagccaccgtatccgttttgtcgatttgctcacggcaaaccgtgcaaaattccgccaacaacgcaaatagttgagcggtctttttctcgcctaattttgcaaaagttttatccgccaactgctgtgtcgcctgccaaaccggttccgccttcgccttgccgtctgcggtcaaatgcattattttttcccgtttatccaccgcactttcgctaaactcaatccagcctttttccttatattccttgcaaacattaaacaccgtctgtttcggcaacagccattcatcgcaaatctgcttttgcgtacactgccccctttccgctgccgccaacgaatacagcaccgcaaaatggttataacccaagcctaatttggagatccaagcgtccattgtggcatctacttcactgatttgtttacctagtttgtcgaagttgctcattgtttaaagtcctaaaaattactaaattgagtgctattttagatgtgagaaagagaaaaggcaagagatattggtattaaaatttgctttttaaaaggtgaaatatctttttatcaattgaaaaaatgttatttatattcactttttcattggaaaaagtgtgtttttagcaagattttcgttgataaaaatgtttttgctgcctaaatttaaaggggctttaaccgagcaatatgtgttacaacaattgcttgcaacccaagaaaatcccgttttttattgggcaacagaaaaaggcacggcagaagtagattttgtactacaacgcaaacaaaccgtaatccccattgaagtcaaagccgaagaaaatttgaaagccaaaagtttgaaagtgtacgtagaacaattccaacccgaacaggcttttcgtttttcaatggcggattttagggaacaggattggatggtgaatgtgccgttgtatggatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagactaaacaagatttcagtaaggagcttgtatgagcaaatcagaaattgtttcttcagtggcggaatatctcacctttatgaccgctacaggcgagagccaagtcaatgccatttatgcggatgaaaatgtctggctgagccaaaaaatgatggggcagctttatgatgttgaagtacctacgattaattatcatctaaaaaaagtatttgatgataatgagttagacgaaaattcagttattagaaattttcgaataactgccgatgacggtaaaaattaccagaccaaacactataatctttcggcgattattgccgtgggctataaagtcaattccgagcgagcggtgcaatttcgcaagtgggcgaccgagattatccaaacctacaccatcaaaggctttgcgatggacgatgagcggttaaaaaatgacggcacacgtttaggcaaaaagtattttgaagaacaacttgcccgtatccgagaaattcgcctgtcagaacgcaagttttaccaaaaaatcaccgatatttatgcgacttccattgattacgaccgtactgccaccgcgaccaaacgtttttttgccacggtgcaaaacaagttacattgggcaattcacggtcataccgccgcagaattgattgtggaacgagcaaacgccagcaagccgaatatgggcttgaccacttggaaagacgcaccgcaaggcaaaatttaccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtggtagcgaaaaattatttatccgacaacgaattggctcaactgcaacggttggtatccgcttatttggatatggcagaagatatggcattacgtcaaattccgatgacaatgcaagattgggaaaccaggctcaaccgctttttagacgccactgaccgagccatattgcaagacgcaggcaaagttaccgccgaaatcgccaaagcccacgccttgagcgagtttgaaaaatatcgtgtcattcaagatcaacattttgaaagcgattttgaccgcttgttgaaaggggaagggtaaaagagtggtaggttctggggagattcggtatttttgctggcatattattcggaggtatcacttattggcttgttgggttattttcatctagcttagctatagctgctggaattgcaataggtatgatattttggattgtgataccatctgtaaacaaaatgcaataactaagttaatatgtaatgcctccaatatgggggcattacatctcagaccgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtcaagacctaccctacaagctgattatctatttatttgcaaaatcttcatgagagaataccgcttatttaattaccaagtggtataaaacaaatagatatttctaaataccacttataatattacttcatctcagccaacgccaaatccgccatttcaagcgtataagcaatatcttcatcgctatgtgctaaagacataaaacctgcttcaaaggctgatggtgcaagatagacacctttttctaacattttatggaagaaggtattaaacgctttcacatcacatttcatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatcacatttcatcacatcttgatagctttcgattttggtttgttcggtaaagaatagaccaaacataccgccaacatactgaactgtcatcggaataccgtgtttatccgctaaggctttgaaaccttccgcaagggttttggttttctcagcaagcagttgctcattacctgcttttgatagctccgttaagcaagccaaaccagcggacattgcaatcgggttacctgaaagcgtacctgcttggtaaacagggcctgttggtgcgataaattccataatctcttttttaccgccaaacgccccaaccggcataccaccaccgatgattttaccaagcgtggttaaatctggggttacgccgtagtaactttgagcaccaccaagtgcaacacggaagcctgtcatcacttcgtcaataataaatacggcaccatattgagtacagagttcacgcaagccttgcaagaagccttcttttggcggaatgcagttcatattacccgccacaggctcaatgattagacaggcaatgtcgtttggatattgttcaaaggcttgtttaaccgatgctaaattattgtattcgcaagtgagtgtatgttttgcaaaatcttcaggtacacctggtgagcttggctgaccaagggttaatgccccagatcctgctttaactaatagtgaatctgagtgaccgtggtaacagccttcaaatttaatgattttgtcacgtttcgtatagccacgggcaaggcggatcgcggacattgtcgcttctgtgccagagctgaccatacgcaccatttcgattgacggcacaagtttgcagactaattcggctaattcaatttcaatggcagtaggcgcaccaaaacttaatccgttgggtacggctttgagtacggcatcaataatggctgggtgattatgcccaagtaccattggcccccaagagccaacgtagtcaatataacgcttgccttcgctatccgtaatataagcacctttcgcactgtcaataaacacgggcgtaccaccgacacctttaaaagctcgcacaggcgagttcaccccacctgggataacacgttgtgctttttcaaaaagagattgagatgttgtcataagaatccttaacgtgaatcacgtaaaatggagttattttactgtaaattacgctttctgcgtgaaaaaaattgagtgtttcagcggttatgctatgctagccagcattttagttttcccttattgaaaggataaaccgagtatatgtggctgacatttattgctgtatttttggtttcttttatctcacttattgcaatgcgtcctgtggcggaaaaaattggtttagtcgataagcccaatttccgtaaacaccatcaaggtgtcattcccttaattggtggtattgccctttatcttggcaatctcgctttctacttattggaatgggaacagatgcaattgccagagctgtatttgatcgcattaaccattttgttaatgattggcgtgttagatgatcgctttgatcttagtccatttctgcgtgcaagtatccaagccgtactcgctggggcaatgatttacagcggtttatccattgaaaacctagaacaactgaacgctccttttagcttggaaattggggcattaggtgtcgtactaaccgtctttatcaccatcggcatgattaatgcgttcaatatgattgatggtattgatggcttgctcgcaggactttcttcggtaagttttgctggattaggcacattaatgttacttgacgagcaatatacgctagcctattggtgctttggtattatcttggtgttactgccttacgcaatgtttaatctcagcgtttttggggcaaaatggaaagtctttatgggcgattcgggcagtaccctaattggttttaccatcatctggattttactactcagcacacaaggacaaagacaccccatcagcccaataacaggtttatggctgattgccgtgccattaattgatatggttgcggttttcttccgccgtttgaaaaaaggtaaaagtccattcagaccagaccgcttgcatattcaccatttgatgatgcgtgcaggtttaacctcacaccaagcgttagcggtaattacctttggtgcagggctttgtgcgaccttcggcgtaattggcgaagtttattactggaaccaatgggtaatgtttgttgcctttgttttccttttctttctatattcttattctattgtccaggtgtggcgaattactcgatttgttcgtcgccacaaacgccgtgcaagaagaaaacaaactgtttagaggctaaaaatgagtgagcaagtgaaaacacaacgttctagtgtaggactattttttacatctttatttttattattaatgctttctgctattggcggtgtagcgggttggtttggtgcaacaacgcaaacagcttattggaaagctgaggcacaatttgaagtccctaaagatcaactgttatgggcagccattggtggcggtattgggttactgctaggctttttcgttgtgttgttcattaatcgtaagaaaaactagcttgtggcatatcgtatcttagcggtctttggtactcgaccagaggcaataaaaatggctcctcttattaaaagattgcaacaggaagaggcttttgctattcaagtttgtgtaacaggacaacaccgccaactactcaatcctgtgttatctttgtttgatattcaacctgactttgatctaaatatcatgaaatcagggcaagatctggcaaatattacaagccgtattttgctaggagtaagtgaggtgttgtctcaatctcagccagatcttgttttagttcacggcgatacaactaccacatttgctgccagcttggcatgctattatcagcgtgtaccgattgcccatattgaggcaggactacgtacaggaaatcgtttttccccttaccctgaagaagctaatcgtcatttaaccagcgtgttagccaactatcattttgccccaacagataaggctaaagctaatttattggcagaacatcatgcagaagatcgtatttgggtgacaggaaatacggttattgacgctttaatgatgatgtcgcaaaaaattacacaaaaccgaccgctcacccaacagctacagcagcagtttccctttttagattcacataaaaagctgatcttagtcacaggacatcgccgagagaacttcggtgatggctttgaacggatttgtcatgcattacgaatattggcagaacagcatactgacatacagattgtctatcctgttcaccttaatcctaacgtaattgagccaacccaacgtttgttagccaatattgataatctctttttacttgagcctcaaccttatttgccttttatctatttaatgcaacaagcctatttaattttaactgattctggaggtattcaagaagaagcacccgcattacagaagccagtgctattaatgcgagaaatcaccgaacgtcctgaagctgtgttagctggcacagtgaagttagtaggaactaataccgagtatattgttcaaagtgtgaaggcattattaaacgatccacaacaataccaacaaatgagccatgctcaaaacccatacggtgacggtaaagcgagtgaacgtattgttgcggtgataaaacaacttgcacaaggaacaatgtaatggctgtatttgaaaaaatagtcgttgtaggactgggctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcggtttacctacagcagcggcttttgcacttgcagggcagcaagtaattggcgttgattgtaaccctcatgtgatcgaacaaattaatcaaggtcgaagtcatctacatgaacctgaactagctcaagctgtattacaagcggtaagttcagggcatttttatgcaagcacggaaccaacctttgccgatgcatttattattgcagttcccacccctctacaggcaaaccgtcaaccagatttaaccgcaatacaatcagcagtgaaaagtatcgcaccctacttaagacaagggaatttagtagtattagaatctacctctcccgtaggaacaactgaacaacttgctcaatggattgaaaaagaacgccctgatttatctattcccacagatgtggcggtcgcttattgtcctgagcgagtattgcctagcaatatttggcatgagctctatcataacgaccgtgtgattggcggattgaccccgaactgcacacaacaagcggtagcgttgtatcagctttttgcaaaaggagaatgtattactactgactctcggctggctgagatgtgtaaactcactgaaaacagttttcgagatgtgaatattgcttttgccaatgagctatcaatgatttgtgatcaactcaatgtcaatgtttgggagttgatccgcatagcgaaccgccaccctcgcgtaagtattttacaacctggagctggggttggagggcattgtattgctatcgatccatggtttattgttgctcaatcagaacatgcacgcttgattcgtactgcacgagaagtcaatgatagtaaagctttttgggttattgataaaataaaaagttgcctagccgaatgtgccgttgcaacaaatcgtaaaatttctgatctgacattagcttgtttagggattacctttaaagctaacgtatccgatctgcgagagagcccagccctagcaattacagaatactttgccgattggcatcagggtaaattatggctggttgaaccacatatagctcaattgccagcttcccttgcagaaaaagtagaatgggtggattttgctcaaggtatcacagcggatgttgtcgtgttcttagtagatcatctggcatttcagcaacatgctaaaagacatctatctcctacatggttggtggatacaaggggagcgtggacagattaatttggtttattactcagattaagtgaaagagcttgtatatataaagcaatcatctacaattcactttatcttgaagggagaaaattatctatgtttaaaattatttttacactcttttccttgagtacattttatttgcctgctactgcaagcctatttagctcacaacctaaatttctacccggcgatcaggcatttgcgttttcatctcaacagcaagcggatcaactgcaactcgcttggcagattgccgatggctactatctttataaaaaagagatcgccatttcgtcaaacaatgccaaactgggcgagccacaatttccaacggcagagcgttaccaagatgagttttttggggaagtagaaatttatcgcaatcagctaacaatccccgttgcccttgaagcgaatgcgactgggcaagtgctggtgcgttatcaaggttgcaccaaaggcttttgctatccccctgaagaagtgacccttgatttacaagcggcgacttccgctgataatgttgcaaaaaataccgcagatgttaccgctatttctgtcgctcaacctaaagccgaacagaaccaacttgccgaaaccttagccgaaaatcgccttgctattttttggttctttgtgttagggctggggcttgcctttacgccttgtgtgttaccgatgttgccgctactgtctgcgattgtgattggcagtaaacagcgtccgaatagcctacgcgcgtttttgctcagtttaagctatgtgcaaggaatggcagtcacttacacgctcttagggctactggttgcggcgattggcttgccttttcaagtcgctttgcaaagtccgcctgtactgattgggctttcgttgctctttattttgctcgcaatgtcgatgtttggtctctttaccctacaacttccacaccgttggcaacaaaaattaaatcaactaagccaacagcaacagggcggatcgttttttagcgtatttgtaatgggaatgatcgcagggctagttgcttccccttgcacatcagcacccctatctggtgcattgctctatgtggcacaaagcggtgacttactgacaggcggtttagctctctacctattagccttaggaatgggcattccactgatgttagtgacccttttcggcaaccgcattttgccaaaatcgggggattggttgctgaaagtaaaaacgctgtttggcttcgtaatgttggctctgcctgtctttttgctctctcgtgtgctacccactgttattgagccactgctgtggtcggctctggcgatagtctttttactctggttaaatgagcagtgcgatggtttgcagggctggaaaaaagtgtttcgtttgcttgtattggcaacgttggtcgttgcgagcaaaccttggctagatcttgcgtggcaacctacgccagtaaaccaaactcaaagcaaccattttaaacgcattcactcccttgcagaattagagcaacaactgaccgctaacaaaggtaaaaaagtgatgctcgacctgtatgccgactggtgcgtggcttgtaaagagtttgaaaaatatactttcgttgatccaaaggtgcaggcgaaattggcagaaatggcagtgttgcagatcgatatgacaaaaaactctggtgaaaatgatgaattgatgaagcattttcaagtgctgggcttgccgactatccttttctttgatgagcaaggcagggaattgagccaatctcgtgtgacaggttttatgcaggcaggtgactttgttcaatggttaaacggattaacacaatgaaaaccatcttaattacaggctgttcgtcgggcataggttatgcaacagcccattatctcaaacaacaaggctggcgagtaattgccagttgtcgcaaagccgaagatgtacaacgtctgcaatttgaaggctttgaatgtgttgaacttgatgtgactaactcagcccaaattgcccaagtctttgattatattcaacaaagcggtggtttagatgcagttttttgcaatgcaggttatggacagccagggacagtggaagacattccccgtgaagccttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgaaatttttgaaaccaacgtatttgggacgtgggaagtgatgaactacgctttaaagctatttcgccaacaaaatcacggacggattttaatcaatagtagcattttaggctttgctgcaatgcactttcgtggggcttacaacagcactaaatttgctttagaaggtatggcagacacccttcgccacgaattgcacggctcgaatatctatgtcagcctgatcgaaccaggccctattcaaagcaaattccgccctaattctgtggtgaaattacagcaatatattgatatagaaaattcattccacaaagaagcctatcagcaacagttggcacgcctaaacaccaaaggaaatgccaacccctttacgctaccagccattgaatgtgctaaagtttgtttagacgcactcaattccaaacagcccaaagcacgctatcaagtgaccttcccaaccaaactattttggtggctaagacgcattctgcctacaaaagcctttgatttttgttgtaggaagggtgggggatgatagtagaaacttactatgattgatgctttttatgttagctttctcatcacaattgtaaccatatgaaaatgacacttttggattgatgtattaaataaatcctttaatagccctctacatccaccatttgtaatggattgaattctatggcttttttcacgaagtatgttcaatgcgagtttgtaaaggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaagccatttttaccaacacttttgtctactatgccgataattatttcccaatacaaaaggaactgaaaatattaccgagtaaatcgtctgaggtaaattgtcctgtgatttcgcttaaggcattttgtaccattcgaagttcttctgccaataattcacctgcatagaactgggttaattgaatgtgtccacgttctaaatgttctgcagctgtttcaagtgcaactaaatggcggcgacgagcaataaagccaccttcggtagagctttgataacccattgatttttttagatgttctcgcaataaatccacaccgactttagtttgtgctgacaggcgaatcacagtgaaattatctgcttgaaccaaactttctgcttctcctgttaaatccactttattacgaataacagtcacgggaatgtttttcggcaacttcgctaaaaatgtcgcccattcttgttggaaactatccgcttgagattcattgctatcaatcattaataaaacgtggtcagcctgttcaatctcgtcccacgcacgtttaatcccgatcttttctacttcatcactggcttcacgcaaccctgcggtatcaataatatgcaacggcattccatcaatatgaatatgttcacgcaacacatcacgggttgtcccagcaatatcggtaacaattgccgcttcacgaccagctaacgcattgagtaagctagatttgcccgcattaggtttacctgcaattacaactttcataccttctcgcaaaattgtaccttgcttagcctcctgacgaacattagcaagttgagcgatgatctcattcagttttgcttcaattttaccatcagctaaaaaatcgatctcttcatcagggaaatcaatcgccgcttctacataggttctcaaatagataacagaatcaaccaattcattgattttattggaaaattcaccttgtaatgattttagagcggaacgagccgcttgttcagaggttgcatcaattaaatctgcaatggcttctgcctgtgcaagatcgagtttattgtttaaaaaggcttgttcagaaaattcacctgctcgagcaatacgaaccccttttacttttaaaatgcggttgagtaagaggtctaaaatcacttgtccgccgtgtccttgtagctcaaggacatcttccccagtaaacgaatgaggggctttgaaaaagagggcaataccctgatctaacacggtcccatcttcatctttaaaaggaagataatcagcaatacgaggcttagggcatttacctaagaccgcttgtgcaacctctgtggcgataggcccagatactcgcaaaattccaattccaccacgtccaataggggtagcttgtgcaacaatggtttctttcattttaaataagttaagtataatgagaatagcatattgtaccccataaaagcggtgagattgagataaaattttactagagttgagattagacgaaaggagaaagccatttttagtgtagatatctactcatgtaaattcttgtgatctagttcacatttataacttattgatattgaaaggattatctataatttattatggtatagcttctttcatttatcaggaggttatatgttaaatctaactcgtcgttctcttctattagggttaggtggagctgcagctctagctatcacaccatctattgcgaattcagcagggtttaaagtacgttctgctcaatatagcactaaagatcgtcaagtaggtctagcttatgctcgttctaatgatggtatcctgtgggaaaaaacctaagttgggcattgtggattttgaagggagtaaagagaacaatattattatgcgagatgtggcaggaacaggtattttatatgaaccaacggaagttgatccaaataaacgttttaaattaattactcgtaaagaagataataagaaaatggcggttgctttctcagcagatggtatacatttctcgccgttagttgagtggaaggaaaatagcccaattttgggagctgattgccacaactctgtttttaaagatagtcgtactaatcaatatgtgctgactactcgtttataggcaagtaactttcgggttctggctatctcacgcagtgatgattttattcactggtcaccattggaagaggtgatccgaggtcaagggtatggtgaacaaacttactctatgacggtatttgaatataatgatatctatttgggactggcatctatttataaacaaggtgacaattcagtgatggattttgatactttgaatttagaactgtactggtctacaaatttgacggaatggaacaaagctgtacctgaacataatatattgattcctgctggagcaggcagagagaaataccttgatggggagtttgatagtgcaacaatatttgcatcgtccatgacggcaggagataaccgtatttattatatgggagggaaaggtcgacatcgaggttggcgagagagtggactagggcttgcatttgtagataaagatagacttgcagggatggttgctcgagatccagctaaaccaatgcatttttcgacacaatcatttaagttctttggagaagatctctttattctggctgatattgaagataatggcagtttgagtatcgaagtagataaaaaagaggggttcgaattcgcaaatgcagagttgattcaggtagataatggatattatcaggtacgttttaaggggcaatcattggtttctgcatctcaagaaaaaggtattccattttcaatcacttgcatcaatacaacgttttgggggattagagggaattttgaaatggatgagactcgttattggaagggataaatatgtatataaaaaagaaactcagaatatacaatcttttaattatatattaacaagcgtatagtctataaaggctaaccattttgtttgatagtagaaaaaaagtgttgttgaagagttaaatccttatagtgcaaagttttaagccctcttttaattaaatctattgcaaatgatagatgtagagggctattcaatacatcaatccaaacgtatcactttcatgtggtcatcattgctatgggtggttaaatttttcttctgacagtaccgcttacgaatctacaacagctttaggatccgcaccgtatttattttcaaaacgatctccgtcaatgaagaagagtaacagatagaaaataacagtgataattaatactacaataataacaactgctttcagcgttgaaaaatgattgtttatgacatcttcaatattatatcctgcaatgactagaacaattgacatggctagctgacaaagttgccaccaacctgaacaacctagatcatgtaaacggcgagtaacaaggctgattgatggaataatcaaaatcaatccaaacaatagatttaatccattgagcagttccgccaaactaaacattcgtaatacagttgcagctgagctaaataatgaaaaacagagatcaataagaatgatgattaagataaaccagccatactctgctcgtcttgctctgcccttaaaattaaagctgttttttagtgcgtgaataaaccatttcattcattttcctcctttggttagattaaattttgtgaataatgaggtttatttttccacttgtaaacttcaatatgtggattattcctaataattagctatgaagaggggattagatagcttatcgcataatctaacgcatagtcgtaaccttttgcccctaagccacagatcaccccttttgccacatcgctcaaataagagtggtggcggaaaggttcacgggcgtgtacattggatagatgaacttcaacaaaaggaatagcgacagataataaggcatcacgcaaggcgatgctggtgtgagtaaatgcgcctgggttgataataataaaatcaactttttggaagctttgatgaatgcgattaatcaaaggttcttcaccatttgcttgaaaatagtcaaacgcaaagccttgggcttctgcttgttgttttaaatgttgctcaatatcagataacgtttgtgaaccgtagatatgaggttcacgctttccgagcatatttaggttggggccgtttaacagtaaaatggtttttatacattctcctataggatatttgtatttaatttatgtaccaataataacattacatattaaagcatatttttagaaaaaaatactaatctaattaaagttgtttctgatttaaagttcttatttattccgataatatctttcaaatcagtaggtagaagagggttattaaaaggaagagctattgtagactttagataacctattttatttttaagaattggacggttgggataaatgatggatgtaaaaaaggcaatatatttgactatattgccattaaagataataacggtattatgcccaatatttatcaatttccgcacgaattgcttcagcggttgctttacctttttcaccgactaaggcacgacctgcgatgaaggctttggcatttttaacttctttgaaaagatgaatttcttcaggaacgataccgcctgtaatggatagttctaaaccttttgcagaaagttgtttcattaattcaatatcttctgctgtccagccttttcctgctaattcagcatcgcgtgagcggtggtaaatcgcttgtttcacgcctaaatctacccactcttgtgcgtctttttcaacggtccagttgccgtagatttcgatttgaatttcttttttcacttttaattcagggtgagcggcattaaattcatctgccacttttttacaagctgctttggttgctgggtgagctgctgctgaaacggtaagccagtccgcgcctgcttcaaatgccattttggcaaggattgcaccgccatcggtggtttttaggtcacatacgatgatgtggtttgggtgtaatgctctgagtgttgaaatggctttcataccttctgcacaagctaggattgtgccacattcgataatatcgacaacatcttctgcttgtttggcatcagcaacagctttttctaaacttaaagagtcaagggcaatttggagaagtggttttgacatattattttccttttaaagattaaaaattagggttgcaagcggttagatttgagaaagaaatagcgaaactatataaatattaaaacaacattgtagggacgccacgcttggcgtcctttaaatatcatctttactatatttgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttctcttgtgtgctgaatatttaccaaaaacaacgttttcccaaccgcttgtatgaattagccgtttaatgctgcatcaatcacagcatacacatcttctgcggttttacagcggcggattttatctaaatcaacgcctgtgtcgctatctggatcatcaagcacttgggtgatttccattaagccttgcatatgttgatctgagtcgctacctgcaagggttaaaagtacatcaacaggctcgtcttcaccttcaaaatagattggtgtgtcaagggtaacaagtgcaaatgatgttttgattaccccttcttctgggcgagcgtgtggcattgctaaacctggtacgagaatgatgtaaggtcccatctctttgattttgcttacaatattgtcgtaataacgtggttcgattgtgccagcggtaacaagtaagtctgtgccgattttgatagcttcttcccagttgcttgcggattgatgaagtttgattgagttattttcaattaaagattgttttaaattcattgtacacctcttggataaattcccccctttgaaaaggggggattgactaggttacttagcgttatgtttattgattaactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtagtccgttacggcacaagagtccataatatttgggataccacgtttatctaagtagcctttgatcttcattttcatcatcattgatgaaccttgacctgagccacataccgctaagatacgaactggttttgcatcactttgagcaggtgatacttctgctttttcttctacttttgtttcttgttgagtttgaacttcatctaagccgtagccgtctaattgttcaagtgttaagccttttgctgcagcttctgcttcttcagcgcgtaagttgcgagaagcgaagaacatataaaccatcgctagagcaacaatgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatcgctagagcaacaatgatgaagaagaagcctggtacgctaatgataccttgtaggattggtgggaagaataatgcccagtcagccatacccatccaaccgttgaaggttgtaccttggcttgctaacatttggattacccacgcagaacctaatacttcgatcatacccatcacgaaacagattttcattaccgctttccagccaccgaattggttcgcaaatacaccgatagttgcgttagagaagaacatcgggataaagcctggaatgatgagaattggtgagccaaagcctaataggatacctactgccacgaactgaccgattgcaccccacataaaaccgaataccatcgcatttggtgagaaagcatagattgccgcacagtcgattgcaagtactgagttcgggattaaacgttcagagatacctttgaatgcttctgaaagttctgcaacgaacatacgcacaccagttacgatgatttgaattgctactgcaaatttcaagcccatttcaagaatgtacataaaccagtgggttttacctgccatttgttgcaagttatctaaaccgaatgaaagtaagatgataccgaagaagattgtcattactaacgcggttgcagagatactgtcgtggaagatatgtaaccattttggtaggttcatatgatcgactgagtcatctttgttaccgagtttcggtgcaagttttactgcaatccaagacgcgatttgttgttggtgaccgatagagaaacctgcaccgccagtaaccgcttgtgttggtttatatataatgttagaagagataccccagtagagtgccattaacacagaagtatagataatggtttcccacatagaagcaccgatgatcatatagaacaccgcaacaagccctgcttgttggaacataatatgacctgtaagcataatggtacgaataccagtgaattttctaaataccactaataagatatttaataataatgcaccgataaccgcataaccaacccaagcatagttatccgccattgtttgaatggtcgcttgcatactggtgtaagggtcgattaccgcacctgttaaattatggaatttagataaaccttcgataacaggtttgaagttggttacaaggaaacccgaacctgcttgtacaatcataaaaccaacgatggttttgattgtccctttaatcacggtggtggtgtcttttttcagaagaatgtaacccaagcaggctacgataccaagtaagaatggtgctttatttaacacctgatcttttaaaaagagcaggatatctgtgagcatttccataagagtacctcttattttatcaataaatatatggagaaaaattgctctcagcgcaatgctgagtgtcgaaattccgacaagtacgaatttaacatcgtgcataatagcaatttcatacgactaaaaaagattgaatttgattatttgcgaactatgtcacattatttttgtaaagaaaagttgttattttttacaaatgtgaggtggacaaaatatgcctttgttaataaaaacgttactcttataaatatattctatgtttttcaatatgttgtagatgacaaaggttatcaataaataacgtttacataaaaaattagatatagatcacaaaattacaaaaaagagtgtacatttttctgtgattggttatgattacttgtgattattttattctttcctaactttgttaatcataggagctaacaatgagcaaaatttcagaaatcacccgtgaaagttggattctttctaccttccctgaatggggtacttggctaaatgaagagatcgaaaatgaagtcgttccagaaggtaactttgcaatgtggtggcttggctgtgtgggcgtgtggattaaaaccccagcaggtgcaaacatttgtatggacttatggtgtggtcgcggtaaaagcaccaagaaagtaaaagatatggtgcgtggtcaccaaatggcaaatatgtcaggtgttcgtaaattacagccaaacttacgcgctcagcctatggtgctagatccatttgcaattaatgaagtggacttcattcttgcttctcactaccacagtgaccatattgatgtgaacgtagctgcagcgattgtaaacaatccgaaattagatcacgttaaatttgttggtccgtggcactgtgcagagctttggaaaaaatggggtgtgccagaagagcgtattatcattgtgaaaccaggcgatgtggtgaaattaaaagacgttgaaattcacgcattagactctttcgaccgtacctgtttagtcaccttaccagtagaaggtgcagaagctcaaggtggagaattagctggtctttgcccatcagatgaagaaatgggtcgtaaagcggtgaactatgtgtttaaaacaccaggcggtaacatttatcacggtgcagactctcactactctattcaatttgcgaaacatggtaaagagttcgatatcgatgttgcattaaacaactacggtgagaacccagtaggtatcgcagataaaatgacctcaatcgatcttcttcgtatggcagagtgcttacgttgtaaagtgattattccagttcaccacgacatctggacaaactttatggcaagcacccaagagatcattgacttatggcgtatgcgtaaagaccgcttacaatacaaattccacccattcatttgggaagtgggcggcaaatatgtttacccacaagataaagacttaattgaatatcactaccctcgtggttttgatgactgcttcgagcaagaaccaaatattcaattcaaatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtaacgtgagtgaaatcgaccgcgagtctggtttagttgccgttaaaccatctggcgtagattacgatgtaatgacagctgatgacattgtgattgttgatttacaaggcaatcgtgtctggggaacgaaaaaaccgtcttcagataccccaacacacttagagctttatcgtcaattccctgaaattggcggcgtggttcatacacactctcgccacgcaaccgcttgggcgcaagcaggggaagatattttggcacttggtacaacacaaggcgattacttctacggctctgtaccttgcacccgccgtatgaccccagaagaaatcgcaggcgaatatgagttggaaacaggtaaagtgattgttgaaactttccgtaaacgtgcgattgagccatcaatggtacctggcgtgctagttcactctcacggacctttcacttggggtaaagatgcatttgatgcggtacataactcagtagtattagaagaagttgcctatatgaattttgtcagccaccaaatccgtccgaatattggttcaatgcaacaagagctgttagacaagcattacttacgcaaacacggtaagaatgcgtattatgggcagtaataaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtggccattttgtatactatgccatttttccctctcgagaaacattagcctgcctataaagaaaactgttaaatatctcccagacaattaatatactctcacttttggtggagtataactttgaataaaactttcaatttctaccaaattatctgaaaacagtgttttgtttctatccgcttgagtgagaaagccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtgagaaagccttgttttaccatattgtcaaaaaaggcttttaaatcatcataatagccatcactattaaacaaaatacacggattggggttttgaccaattctcgcccacgagatcacttcaacgatttcttctaaagtacccggtccgcctgctaacgcaatataagcgtcacctaattctatcattttgctcttacgttcaggcatagaattgacggttatcatctgcgtcaagcccttatgtgccaattctctttcctgtaaaaaagttggcataataccaatcacttcaccaccattttccaacacagtatttgctaataagcccatcaaacccgcattaccgccaccatagactaacgtatgttgatgttctgcaatccatttacccaattcaatcgtcgcttgttggtgagccaaattattcccgacacttgctccgcaatagacggttattttcatttctttttcttcctattttgttaaagtagtgacagatggtaacaaataatcagagagaacaaaatgcactttcaagaatatcaaaaatgggtgagagaattttatcaactgcagaattggtacgagcgagatgtttttcgtcgccttgcttatctgactgaggaaattggcgaggttgcctgtgccgtgcgtgctattgagattggtcgagagcgtcctgatgaaattgagcaagatgccttacagaaaaaagaaaacttaattgaagaattgggcgatgtgtttgataacttatttatcttagcggataaatacgatattgcgattgaagatgtgattgctagacatcaacaaaaatttactaaacgttatcgtggggaataaacaagcggtgagatttacaaaaaattttgcaaatctcaccgcttgtattccttatttctctgaagagaaacccgatttcaccccgtgcatatttggcaactggtgagcaatccctttatggcagtcaatacaggttttaccttcttgttcagccattgcgtgcatttttgccgccacatttttttgctgagtgaagtccatatcgctgaagttatggcagttacggcactcttgtgaattgttggctttcattctcgcccattcacgttgagccatttctaagcggtgtgcttcaaatttctctttggtgtccactttgcctgttagatgagcaaaaacttcacgagatgcgacaattttgcgtgtccatttcggaataaattcgtgcggtaagtggcaatctgcacagtccgctttaacaccactgcggtttgagtagtgagcagatgctcgatactcaggaacaacatcattcatatgacagcttgaacaaaactcttctgtattagtgtgctctaatgctgtgttaaatccaccccagaataaaataccgccgatcgcagaaacgacaatgagaaaaccgatgccgattttgcttggggttttaaaccacgtccaaaattttttgatgagcttaaacattatttacccccaaatgctttggtcggttcaaattggttttcgataattggatcaacatttgcttgtggaacgtggcattgtaagcagaaataacgacgtggtgatgtgtcaccagttactttgccgtcacgatccataaagtgtgttgggctaatgcgtggtgcacctgtggtacgatagttctctacgccgtgacagtttaaacattggttggtgtttttggtcacttggtagcctttaatgctatgtgggatcattgggggttggttcacatagctaagcggtaactttccttcatcttttggcatattgtggaaagcaggttcaatcgcttcaacacctttatctgcacttgacgggactttttctacattcgcaaaagccacacctgttactgcgattaataatagggcgagatattttttcatttttcactccgttcacgttcaaaacgtgttgtaaaactaaatacattttctgcacagacatcaacgcaacgtccgcaactaatacaatctttcgataacactatttggctatcttcgggtttaccatttaagggtaagcgtagtacctgtggttcagggcaaacgtggaagcaatccatacagcgatcacacttcgcacgatcaacaacccctactcgtacaatgctttttgcaccgattaagccgtaggtcgctccgattgggcagagatgtccgcaccaaccgtgttccacaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataagaaaaccgctaacactaaccaaagcgttgcaccaagaccaaagacgaacactcgaccaagtgctgcaacggggttgatccattcccataataatgtgccagaaattgctgacccgactaaaatcatcgctaaaataccgtaacgtaatgaacggggtaatttagcagattggcggatccccagttttcgtcgtagccaagctgcacaatccgtgacaacattgacagggcaaatccagccacagaataccttgctggcgagtaaggcatatattgccacgataatcgctgcccccagtaaggttttccattcaggcaaatagcctgtggcaaggctttctgcggtaattagtggatcggttaaggggataagatcaaacagcatacttgagctgtaattgccttttaagatccacacattccacatcggaccgcttaagaacatcaacaccacactaagctggcttagtcggcgtaaaattaaaaagcgatatgcacgccaccaaccgagtttttgtcgggcttcaagccctgcatctttcggggaatttgccattacttcaccccctctggcattcgtgttggtagggaaataatgccttctgggttggtttcatcaagcagagaatgtcctgctttctgtttttcttcccaaccaagtcggtaatgtttacctaacattccttttgccaacgacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggtaatactttgattgcggcttcatctaacacacaggcttcttcacacttaccacaccctgtacacgcatcggaatgtaccgttgggataaacattgcgtgcttacctgtacgatcattgcgttgcatctcaagggtgattgctttgtcaattaacgggcaaacccgataacacacatcacaacgtaagccttgccagttcaaacaggtttcgtgatccagcagaacggataaacccattcgagcatcatcaatattcgttaaatttggatctaacgcaccgcttgggcaagccttaacacaaggaatatcaggacacatttcgcacggtttatcacgagcgataaagtaaggtgttcctgcttccattggtgatagcaatgaagccaaatgcaacatatcgtaagggcaagcctgtacacattgtccacagcgaacacaagcggcggtgaaatctttgtcatcggctaatgcacctggtggacgcagtgccacgccttgtcgagcaaggctttggttttgttgtaaggctaagatgatccccacaccacaaacaccgcctgccgtgcgtgtcgcattttttaaaaattggcgacgatttggatcgagtttcaatgcctgttccttatttgcaaattgttgctcaaatctaaccgcttacggggtatctgatattcttcccccatttatgggggaagtaccgccgcaggcggggatgggggatatcaactatgcccccatcggtttcgcttcgctcaaccacttcccccacaggtgggggaagtgttcttggctaagccttcacaaccttaaccgcacattttttgaagtcggtttcttttgagattgggtcggttgcatctaaggttaatttattggctaactgacctgcatcgaagaaagtggtgtaaattaagccttcaggcactttgttacgaccacgagtatctaaatgcgagatcatctcaccacggcgtgaaatcactttcactttatcgccgtgacgtaagcctcgtttttgagcgtccgttgggtgcatccacactaagttattcgggaatgaacggtgtaattcaggtacacgacgggtcattgagcctgagtgccagtgttcaagtacacgccctgttgataaccataaatcatattccgcatctggtgcttccgcaggtggttcatacggtacggctaaaatcactgcacgtttatctttattgccgtagaaagatacgccttccccagcttgaacatatgggtcgtagccttcacggtaacgccataaggtctctttaccgtccacgactggccaacgtaaaccacgtgctttgtggtaagtttcaaagtccgctaaatcgtgaccgtgaccacgtccaaattcggcgtactcttcaaataaacctttttgtaagtagaaaccgaagtggtctgcttcatcattgatatagcctgctttatctgccggtacttggaatttatccacttgaccattgcgatataacacgtcgtatagtgttttacctttatattcagggtttgctgctaatacttctgctggccacatttcatctgtggtgaagtatttagagaactccactaattgccataagtctgatttcgcttcgcctggtgctttcacttgttggaaccagaattgagtacgacgctctgcgttaccataagccccttctttttctacccacattgctgttggaagaattaagtctgcagaaagtgcagaaactgttgggtatggatctgataccacaataaagttgcgttcgtcacgccagcctggcatacgctcttggttaatattcggaccacattgcatattgttgttacacattacccagtaagcattgagtttgccgtcttttaatgcacggtcctgtgccacggcgtgcaagccgactttagtttggataacgccgtttggtaacttccataatttttctgcagttttaacgtgttcagggttagtcaccactaaatccgctggtaagcgatgaataaatgttcctacttcacgtgctgtaccacaagctgacggctgacctgttaatgagaaaggtccgcaacctggtttagaaattttgcctgtgagtaagtgaatgttatagataagatggtttgcccacacgccacgaacgtgttggttaaagcccattgtccagaatgaaacgatattcaaatttggatccgcatacatcttcgcaaggctttctaactgatcttttggcacgccagataattcgtgagctttatctaaggtatattcagaaacaagctgtttgaactcttcaaagctactatcgtgcattttacctgcggtttttgcatttttcgctgcttgttctaatgggtggttatcacgcaaaccgtaaccgatgtcggtttcaccacgtttgaatttggtgtgtttttggataaagtcttggtcaatcgcattgttttgaattaagtaatttgcgatatagttcataatcgctaaatcaccttgtggtttaaatacgataggcaagtccgcaagttcaaaagaacggtgttcaaaggtagaaagtaccgccacttttgcatcttgtttggataaacggcgatcagaaatacgcgaccataagattgggtgcatttccgccatatttgatccccaaagcacaaatgcatctgctttctcaatatcgtcataacaacccatcggttcgtccataccaaaggtacgcataaacgcaaccgctgctgaagccatacagtgacgtgcatttggatcgatattatttgaacgcaagcctgctttaaacagtttagattttgctaccccttcaaagatcgttgattgacctgaagtgaacatacccacgccatttggcccttgctctttaatcgctttcttgaatttttccgccataatggtgaatgcttgatcccaagaaacaggggtaaattcaccatttttgtcgtatttaccgtctttcatacgcaacattggcgatgttaagcggtcttttccgtagataattttcggcaggaagtaacctttaatacagttcaaaccacggtttacttccgcatcagggtcaccttgagaagcgaccacacgtccattttgcgtacccacaagtacgctacaacccgtaccgcagaaacggcaaggtgctttatcccatttaatgctattgtcgttagcgtacacatttttcacaggtaacgtaatacctgcggcgagagctgctgctgccgctgcatttgctttcataaaatcgcgacgattgagttccataaattccccacaaaataataggtaataccaaattaaagtgtttcatcttggtggctataaatcagcgacaccacgataaccccttcaatatctttaatcatttccatacgatcaaccaaatcaggttgataactggactccaaaacaaccacgagcttactctcttcaagtttcaccccgtggatttccgtattcggtaactcagttaaggcttgcttcaccaagtccaacttttcaggtttcacttgaactacaaggctacaaacataccagttgtccgcttcatcgtagttcaatttatcagatacatttctcatttcattcacttaacgggcttgcaacatttctcaccaaagtgaccgcttgtgtcggacaaactgccatacaagccccacaaccattacaactttccacatttaattcaggcattgccactcgccctacttgtcgcttaaaacgaatggctcggctttcacaactatcttcacaactacggcattccacaccgctaaacgtcatacagctttgctgaatttcaacataatgaaaccaagctcgctcatctgttgaacgaaacacaccagcttcacacgcagtcacacacgcctgacaaaaagtacattccccccgtccattcataaaattgacttcgggataaccgccagcccctttcactaaaatttgtgtttcacacacggcaatacacttatcgcaagcggtgcatttatcaaaaaaatttgcaagatcagtccaaggtgctcgaacggcttgatgcccttgctgagccactttttcgtcctgaagtgatttcaaaaaatgtccacgcaaaaagctacggcgaggtaaagtcgtttctgtaaaattagccaaaaatagtttactcaatggataggttattgatgttaatgattgtaacatttataaaacataaaaaatgcaaacaaaatacattttatgaatgttatttgacaataatcaataaaaaagcggtaaaaatgatttcattctcaccgctatatatttgattttataatgatttttcttaacgctgtcttgccttaaagcgagggttcgttttacaaatcacatataatttacccttacgacgaaccacttggcaatctgggtggcgtgatttcgctgatttaagcgaatttaaaattttcattttgttcccttttattccttattttttcgttaagctcgaaatgcctttaaagcgttcattaaatttgcttgcacgtccttcagtattcgcttcacgacgtttacccgtataaacagggtgagaagcagaagaagtatctaatggataaagcggatactctttgccatcttcccataccattgttttattggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgccgcacaagagcggataatccagccttgttgcacactaccgtcgtaaaataacacttcacgataattttcagggtgaatcccttttttcatatattctcctagtcaaaaactcagacttaaaaccataaattaaatacgggattattttgcctgaaacaaaataaaaaagctataatttttttatggtctttgtcacttttttcaacttaaacacaaggaaataacgaaattgcgaactggatctaagtttcttagcaataaatatgctaggctattgctattttgtaagtaggagatcagacaatggcaaaacaaccttatctcatcgccccatctatcttatctgcggatcttgctcgtttaggcgatgatgttgcagacgtattaaaagcaggggcggatttaattcattttgatgtaatggacaaccactatgtgccgaatttaacgttcggtcctgcaatttgcaaagccttacgggattacggcattacttgcccgattgatgtacatttaatggcaaaacccgttgatcgcttaatccctgattttgcaaaagcaggggcagacatcatcaccttccacccagaagcaacagagcatattgaccgctcgttacaacttatccgtgaacacggttgcaaatcaggcttagtatttaaccctgcaacgccgttaagctacttagactatgtaatggataaagtcgatgtgattttattaatgtccgttaatccaggttttggcggacaagcattcttaccatctaccttgaataaattgcgtgaagctcgtcgcagaattgatgccagtggatttaacattcgcttggaagttgatggcggtgtgaaagtcaataacattgctgaaattgcagaagcaggggcagatatgttcgttgcaggctctgcgattttcgatcaaccagattataaagctgtgattgatcagatgagagcggagttggctgtaaaataatactgtaaaatatctaagaggttaaccagagtaaaactatttattatatctatcaggttaaccccttaatggccttaaatttcatcaataatccgatacacccaattctcaagcgggtcgttcagacgtttcatttccaaacgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatctcttcgagcatctcttttttgattgctttgtaagcgtcatcatagaagagattgtgcatttcctcaggatctttgcggacatcataaagttcgcacaaatccgtggcgttgaagaccagtttgtaatctttacgtcgccacatacgctgttcaaagtaaacaaagtgtcctgcaagttggcagagcaagcctttgcggtcgttctctttgttttctctggtgatcggtaaaatggtttccccttggaactctggcggaacttcctgtcctgcgacatcatagaccgttgaggtgaggtcgtgaagatagacgagattgtcatcaacttcattgatacggttagattgtgggtctttgatgatcagtgggacgttgtaggtggtttcaaacataaactcacctttttcaatcatacgatgtgcacccattgcatcaccgtgatccgctgtggcaacgaggaaggtgttttcgtataagccgttttcttccaagaaggtaaacagctcaccgatggcatcatcgattaaggtaatgtagccccagaatttcgtgatcacttctttccaacgctcttcgctggcttcccacattccccacatttttgagatggtgcggaaatgccctggtttgccttcaagcggtttgaagaaactttcatctagcacaacatcttttggatcgtacattgagtagtaaggctcaggcacgatacaaggggtatgtggcccccagaagttaatccaagtgaagaacggtttgccttcagccagcgactcgcggatatattttttcgcttcgtcaatgatgaagtattcaatggtttcttcttttgtaccagaaagtaaaccgcacaattcttgtacacgtaaatgtgggttatcgccaaagtaagctcggctaacttcagggatttcatagcctttttcttctaaccattcacgataacggttcgagtgtgtcggcggttggttgaacactagatttttatagacttggctacctgggtaaccgtagccatcaaaattgtgtcctttaatcccgtaatcttcaggaacagattttgtgccgacgtgccattttcctacgacataagagttgtatccttctaaattacagatgtttggtgcttgttggctgatttcccctgtgccacctttttcaccgtttttaataatcccgtgactagatggcattaagcctgtaaacaatgatgttcgagcaggtccacacacagaagcaggcgtaaaggcattattgaaacgaataccgtccgccgcaagtctgtcaaggttaggggttttgacaatttggtgtccgtaaggaccaagcatatctttgcggacttggtctaaaagaatgtaaacgatgttgttcataacgctattccattattttagggtagggacacactgcgtgtgtccgtacatttgtctttctttggacacacgcagtgtgcccctacactttaattatgctttttaattacgctttatctaccactttctttttaccgaagaaaatcaagataagcacttgcaccacagcccatacgcccataatcattgtcgcattaccttctgcggaagctaaaccaagtggtgataacaccaagtgtaaggtaattaagcctaacactaatgaagccacagctgttcttgcatattcccagtgggttaagtccacgtttgaatggttgatttggttatcttcgtatggggtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggtcgcacgttttaagaattgacctaagataagcattaacgctacatcaaagacgaagagtgaacccattacatacacgaaattcactttgacattaatcacccacactaaagtgaagtaaagtacaacgtgagctaatagggtaatacgagccgctaaacctgatacatagcggttgaacaatccaacggcaaagagtgccacgataggaatgttaaagaagcctgcaaaacggcgagtaaacaagaagataccgtctgtaccgaacattaataacggtgcaacaatcattgtgatgatcgccattacggtaccgatttttttcgcataggcaataagttcttcatcgctgcgttttactttggtaatcgcaggcaataagtcgttacagtagatggttgccgctgaatttaagaatgagttgaaggtacttaaaatcgccccgaataatgctgccacaaagaagccttgtaaccaagtcggtaacactttattgactaaacttgggtatgaggcatcaatcggttttaagccttcgcccagaatgtgatagctcaataaacctggtaagttaaggattaacggtagcaacaagaggaaaagtgctgcaattaaaatccctttttgacccgcttttaaatctcttgcccctaacgcacgttgtactatcgcttggtttgttgtccagtagaagaagttgacgattaagatacccgtgaagatagctggccaaggcacagcgtctgtggcactaccgatagcattgaatttttcaacgtgggttgtgctgataatgtgtaaaccttctgaaatgctaccgttacctaaataagcaagggcaaagataggcacaagtaaagcaccgatcactaagatcaccgcattccaagtatccgatacggcaacggctttcaaaccaccgaaaatcgcgtaaattgcaccgatgataccgattgcaattacggtgtaagtaatcgcttcgccatagctgagattaaacacttcttgtaggctgaagattttattaaatgcaatcgcccctgtataaagtgcggttggaatagcaatgaaaagatagaagaacaagaagagcgtggacataatcaaacgagtttgtctgtcaaaacgtgcttcaaagaactctggaatagtggtgtaaccgttacggatatattttggtaacagatataatgcaaggaaacagagtgggataacagattgtaccgtccacgccataatcgagaagttacctgcataagagtttgcattgatcccgattaactgttccgttgaaagtgaggttaataccattgagcagccgatgactgcaccactcaatccacgccctgcaaggaaataaccttttgaggtgcttaaatcatcatctttggttttatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaagagattaaaccgactgcagcggttacgatgataaaactgactatcgtaagaaacatatagtcctccttagtttcagataaagtttatgaagttgctattctagaaatttagaacagctttagcataatctcgttagatgtaaataaattatgataattgtcataactgtaaagtgatcttgctcacaaatttagaaaataatgaaatttcactcggaaaaatatgaggacgatcataatgggatagcagatttcactttcataatagaagctgtaggactttcaacacctctatattagggggaatttatgacaataaccacaattttgattttaatcgcctgtggcatactgactaatttaatgtcagcactgtttgggatcggcggcggtgtgctaatggtgccgattttacatacactgtttcctgaattttcgttgcaaatggttgctgccacctctttaatgacagtgatgggaacagcaacaatcaacttagtctatttctataaacagcgtgttcctgtcaaaatgaaatctctgttgctgtggtcaattggaatgattatcggcgttcagcttgggtttgaaatcagttttttcattccaaattgggcaattgttgcagtgtttgtgactacacttgttgttcttgcattatgtcttattctcgcaaaaaaatctgagaattccaccgcttgtagctcgttaaaagagaacattaagggaatttcagtgtgcttatttggtggaagtgtcgcaggaattacaggtattggcggtggctcaattatggcacctcttattagtttgttaccaagcgtcaaaccacatcaaatcgccgcttatagcaactatatgatgattattggtggattaggaaacttatacggttatctaagcaaaattccaccagtctatttagaaaactcttggcaagtgggatatgtgaattttaccgttgtgtctattgtggtgctatgttcatttttaaccagtttcttttcaatgaagctgagagggattttaaaaccgcttacaatgcaaaggctgttaagcggtattttgttggtgattgctggttatatgttgatcttgcagggtgttcgttattaggctggtaaatattatttagatagcgtaatttgatgttatgctctatggtatatttaaaacattaatattttgtcatcaaatatggcataatttaattattgatttaatggggactaatattatatgaatatccgagatctagaatatctaatcgctttagctgattttaaacattttcgtaaagcagctgatgcttgtaatgtaagccagcccacactgagtgggcagattcgtaagttagaagatgagctcggaactgtgctattggaaagaactagtcggaaagtactctttacccaatcagggcttaccttagttgaacaagcaaaaactgtgttaagagaagtgaagattcttagagaaatggcaagcaaccaaggtaaagtaatgtctggccccttacatattggtatcattccaacattaggaccttatatttcaccgataatttttcctcaactaaaacaacttttccctagattagagctttatatttatgaactacaaacatcattacttgtggaacaacttgagtcgggacaactagattgcgttattttagcttttgacaaagaaagcgcgccatttatcgaaatacctatttttaatgaaaaaatgctacttgcagtatccaatcagcataaatgggcaacaacaacctcaatagacttatcaaaattacgcgatcaagaaatgttgatgctagatggaggacgttgtctacgaacacagttgatggactattgcttatcaatcggagcaaaagagaacagccactttaaagcaaatagtttagaaacattacgtaatatggttgccgcagatgtaggaattgcgtttatccctgaactagcagctaaaattggaaaaacagataatttacactatattcattttaataatcctgaaccatatagaacaattgggttaatctatcgccccggctccccgttacggttgcgatatgaacgccttgcaaaagagattcaaaaaataatgtcagagattcaataatgagtagtggaatcagagcaatccaaaaagagaaaactcgccgtgcattagttgatgctgcatttaaccagctaactgcagacaaaagtttttcaaatttaagtctacgtgaagttgcccgtgaagcgggcattgcacccacgtctttttaccgacactttaaagatatggatgaattggggttagcaatggtagacgaatcagggttaatcttacgtcaattaatgcgccaggctagaaaaagattagaaaaaggggggagtgttattgctatctccgtagaaaccttttttgaacttattgaagaccgccctaatatgtttcgtcttttgctgagagaacgatcaggaacctcgcaagaatttagaactgccacgtcacgtgaaatccagcattttgtagcagaactcgcagaatatattcaacaaagagatcacgcaataactcaggaactagcttatattcaatctgaaggacttgttactctcgttttcacagcaggttcccatgctttagacttaaatagtcaagaacgagaaaaattaaaacaacgtgtaattacacaattaagaatgctagctagaggagctgcagcttatactgatggtaagaaataaaatgaaaaagcatggcattatcaactgttctatgaaaaatattttgttatttgtgagtttatttgtattgatcaacactgcagcagattggtttcgtagacccaatccctctcatcaatttgcagaacaagttttatatgatttggagaaaaatcctcaaattattgcacaactaagccaccaaaaatcactgttactctatttttggggcagttggtgcaaattttgtgaatatacctccccatccatttctcagcttgtactagatggcgccaatgttttaagtattgctctcaaatcgggaagtgatgatgaagtaaaacagtatatgaaagcgcatcaatatcattttgtgactatcaatgatccaatagggacattttcaaaaagttgggatattcaagcgactccgacattaattattgtaaaagatggcaaaatgattagccacactactggcttctcaacctattgggggattaaaattcggttatggttagccgattgggtgagataaaaacaagcggtcagattgaacgcttgttttgcaaatacactctattttttcactaaaaataaaatcgcatcaatataacgttgaacaaattcgttggttgagcctgaatcggagaaaccttctggatttagctgatattgttcattcacaaaaaatgctggcacgccacgcactttaaattcttcagcagcttgagtttgttttgtcactaaaccattcaccgcaaagctattaatgccgccgtcaaattgttctgcggtaatgccatttgctaagaaaatcgcacgaatgtcgtccattgatttaattgcatctttttgtgccgcttcaaataatggggttttcaccttatcttccgcgcctaatgccattgctaatgcccacgctcgtgttaattctgtcgattgacgacctaaaaaatcaacgtggtactgttttaacactgccccttcaggtaaacctgctttgactttacttggaattttgtaattcaattcaaaatcatagcagtgtgggcaatagaaagagaaaaattctaacacctctttttgagccgaaggcacttggcgaacttcgagatactctttatttgcaacaggatcttgtgccattgcggttgttgaaaaagcccctaatgcagaaagggcaatgaatacggtttttaaagcaaatttcttcataaattcctcgagttaaaaaagtcgatcctatgacaacattaatcatttaaaattccacgcgcttttaataaagcggttttaaaatcttcttcgtaatcttttttgataccagggatcacttcggttttatcttttccacgcattttgagttgataaattaacacttcatcacgcagtgcatctaaatcattcggtttgccaacttcttcagcaagtttgtgtaataaatcaagtaagtgaagatcgggttctttacgccaatgttcacctaatagctctaacacttcgtctaaacgtttacatttcatcagaaaatccttaaaaaatttggaaaaaactaggcaggatcatatacttttaaggttaattttgcaaaaacaaggggaaaataaatgcaatttaatcaaattcaaggggtaattttagcgggggggcttgctcgtcgtttgaatggggtacaaaaaggattgcaacttctacaaggtaaacctctgatttctcatattttggaaagattatccccacaaatttgcaaaatctggttgaatgtgaaccgcttgcaagcgcagtatcagcaacactatcctgatattccgctttatgccgattgtcttgaaggctttcaaggggcattaagcggtatgttagctggctttgagcaaattgatagtgaatatttgctatttgtcccttgcgatagcccatttttacctgaaaatcttgccgtaaaactaagtacagccttacagatcaacaatgctcaaattgcctttgcccacgacggtgaacgcccacacccgacttttgccttaatccaccgttctgtattacctgcattgcaagattatctgcataatggcgaacgtcgtctatttcagtttttccaaagccaacgcagtattgccgttgatttttccgaacaaaaacaggcgtttaaaaattttaataccccagaagattttcttccttattctctccctccgcttgcggagggagatgtccgtaggacaaaggggggcgttccgttgcttgcagtgacaggttatagtggcacaggcaaaaccactttacttgaaaagctcattccccagttaaatcaaaaagggataaaagtaggtttaattaagcactctcatcataatgtcgatgtcgataaagcaggaaaagacagccatcgcctacgtttagcaggggcaaatccgacaatgattgtgtgtgaacagcgttgggcgatgatggtggaaacgaatactctcgcgtcttttaatgtactggtaaaacagatggaaacacaaaatgtcgatctgattttagtcgaaggcttcaaacacgaaaccttgccgaaaattcagctacaccgaaaagagatggataaacccttacctgagttagatctcttcacccttgccaccgcaacggattatctgttggaaagagaaaatctgttggatattaataatgtggagcagattgcggagtttgtggtgggtgttttggaagggtaacgtattggagctaataaacgacatagtaggaaaatttatgtagcaactgctacataatatcgatagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattccttataaatatcgtaatgtaagaagtacttatatcagtttaaagcattatatagattttatttttacctatgagaaatattctgaattaaatatagaaaagactatagatcacttagagggattatttagaaaacttgagtggaaatcaaataatcacaaggggttaacgaaatatataacacgttgtttataaatgattttttaaataaaaaagttgctaatatttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattagcaactatttcgtctactatgccagatatctatattagcatataaccataaataatagtttactgcttatagtaaatcacttccttagccaccaatctatactttatattctaaattactttagattagacatagtaagtcattggtaagattaaatttccttccaccctaactcctgcgaaatagcttgtgcagtttgttgtacctcgcgtataaaatcccccatcgtatattcattcaaacgatgaatagaagttgaaactgaaatggcatattccactctgccaaggtgattaaatacaggtacagcgaggcagcgcacgccaagttcattttcttccctatccattgcaaaaccagatttaagaatatcgttgagttcttgacgcatagcttgaatgtccgtaatggttttgcaagttctctgctcaatctgaccgctatgtgcctgccaataacgatctaaatattctttattttcttcataagcaagataaagtttacccattgcagaacaataaagtggcaaatgttgcccaatataggcacgcgttttcatcatacccaatgttggctcgagcttgtaaatcataatcgcgtgatcgtcttctcgctttgaaaaattgacggtttcacctaaggcaagatttaatcgttctaaatgcgaggaagctaaatgaataatattcattgaagcaagggttttctgccctaaacttagacattttgttgttaaacgataactaccaacagaacttgctgctttcacatacccctcgttttgtaacccttgcagtaaacggtgtacggtacttttgttaagttctgaaatttcagccaatttcgctagtgggcaaccatttggaaagttacttaaaatatccattaaacgtaaaccacgaataaggctttgatttccaccacttttttcctctgccattctgttctcctatttcattttatacctcctatcatagcatatttttctgtttcatattttggaatgcaatcccataaaaatgagatcttgctcacaaaactaaaaatttacaaataacacattgattttaaatggtttttatttttatggtttgattgacttttaatctgtttaagtttaatttatgaaatatcattttgatatatgaaacaaaggggttactaatgaaagtatcatatcaagagcttaaagccgaatttaaacgtgtgctacttgcccgcaatgttcgtgaagagattgcagaagagtgtgccacaatgtttgctgacactacccaagcgggtgtttattctcacggtgtaaaccgttttccgcgttttattcaacagttagaaaagggcgatgttattcctgatgcagtgccaaccaaagtgctttcgttaggggcaattgaacaatgggacgcacatcaagccatcggtaacttaactgctaaaaaannnngaaatcggtcaaggtttattaaaagatttagaagcacaaggattaaaaggcttagctttctgggaagtcgggttccgctcatttactaactcaaaacacccagttaaatcacctgaagacatcaaagggttaaaagtccgtactaaccaaaacccaatgtatattcaggcatttagcctacttggtgcaaatcctgtgccaatgccactttctgaactttatactgcgcttgaaacacgagcagtagatgcacaagaacacccaatcggtattttctggtcagctaaactttacgaagtacaaaaacatttaagtttaaccaatcacggttatactccattaattgttgtaatgaacaaagcgaaattcgacagtttctcaccagaattacaacaagcaattcttgatgcagctaaagaagcaggcaactatcaacgccaacttaatttagagaatgaaaaagagatcatcgctaaattacaaaaagcaggtattcaagtgattgaagaagtagataacaaaccgtttaaagccatcattgaagcagatgttcgcaaagcctttattgagaaaaacggcagtgaattagttgaaaaaattgatgggttagcgaaataatacaccttctctatccccctttttcccaaaagggggatttgctaatacagaaataaaaaggaactcaaatgaactactacttaggcattgattgtggtggcacttttattaaagcagcactgtttgatcgtcacggacaaatctgcggacttgctcgtgaaaatgtagcggtcatcagcgaaaaagcaggttatgcagaaagggatatggctcaactttggcaagtctgtgccaatgttattcaccaaacacttgaaaaaagtgatgtagagccaaccgcaatcaaaggagtaggcatttcagctcaaggaaaaggtgcgtttttactggataaaaataaacaaccactaggtagagcgatcttatcttccgaccaacgttctatcgacatcgttaaacagtggcaaaaagaaggcataccagaaaaactctacccaatcacccgccaaaccttatggacagggcaccctgtttccattttacgctggataaaagaacacgaaccagaacgttatgcacaaatcggttctgtattaatgtcacacgactacttacgcttttgccttactggtgaattacattgtgaagaaaccaatatttctgagtccaatctctacaatatggcagaaggaaaatacgatctccaacttgctgaaatacttggtttgcaagaaatcattgataaattgccgcttgtgatcgccccaaaccaagtggcaggttatgtgaccgaaaaggcttccgctctttgtggtttagcggtgggaacacctgtggtcggcggcttattcgatgtcgtctctaccgcattatgtgcagggttagatgatgaaaccaaacttaatgccgtactcggtacttggtcggttgtcagtggtatcacagaccatatcgatccaaaccaagatttaccgtttgtttacggacgttatgcacaagcgggcaaatttatcgtccacgaagccagcccgacttcagcgggtaatttagaatggtttatcaaacagtggaatttagattacgctcacattaatcaaacgattgccgaactaccgcctgcgactagctctgtactgtttgtcccattcctttatggctctaacgcaggtttaggtatgcaagcaggtttttatggaatacaagcatatcatacacaagctcatctactccaagccatttacgaaggcgtactgttcagcttaatgcatcatctcaaccgaatgctacaacgcttcccgaatactcagatattccgtgttacaggcgggccaacgaagtcgccaatttggttacaaatgctggcggatttaacaggagtgatcttagaagtaccaaatattgaagaaacaggttgcttaggggcagcgatgatggcaatggaagcggctgacgaaaatcgcccagaactattgcaacaagcaatgcgtcaagtgcaaccaaatcctgaacattttgaagcctatcaacaaaaatatcagcgttatcaacagttagttactacactgaaagcattacactagataagttcaagcggtaagatttattgcaaatttagcaactgctcttaccgcttgtacatttccaatcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggctcctacaaaacaggcaattttgcactctccacaaccgttgtataccgatacaaacagatgttcggggcaagaaaacggcgggcgggcaacttggcgagcgatttccgtactcacacttttttgcgtaccgccaagcaaactgcgaaatagccctctgcacgaaagggggcagtttttgtatcgggattccatcaacctctacccaatttgcctgaattaaccacgttctctaatgtttatgcagtttcacctgactgccagccgtttaaatcttatgttgtcgcttcgcttgatgatactgttgtgccacatcaatatagtgatgatttagccaaacatttaaaagcagactatatccgtttgccaactggggggcattttttagatcgggaaggttggaataaatttgagcttatacttgaattaatttgtaaattaaaaggatatacagagaagaattagaaaaataagacatttatttaacatctaactttggcatagtagacaaaatgccatgcctgtctactatgccgcctatttggctaaaaatagcgataggcttcctttacttattgcaataatatttattaagtattttgcttctctacctgattaaattcaagttcaacaggcgttgctcggccaaaaatggaaacggacactttgacacgacctttttcataatccacctcttccacagtgcctgtaaaatctgaaaaaggaccttctttaacacgaacttcttcacctgggtggaactctgttctgtgacgtggtttatccgccgtttcttgaacacggttaaggatacgctctgcttcactctgagaaattggtgcaggcttatccgcagtacctccgataaagcccattacacgcggcacgctttttaccagatgccacgtatcatcattcatttccatttgaactaacacataacctgggaaaaatttgcgttctgttttacgacggcgtccaccaacattctcaaccacctcttctgtgggaacgagcacttcaccaaattggtcttgcatattatgcaatttgatatactcacgaagagtcattgcaacacgggcttcaaagcccgaaaacgcttgtaatacaaaccaacgcattttgcttgtatctttttcttgttcgactatttcaatctcgctcatattagaatctcaaatttgttaggaaatcaacaattaacacaataatagagtcgataccccataatgctaatgccactacaacgcacattgcgacaaccattaaagttgtttgcgtcgtttcttggcgatttggccaaataattttacgtaattcttggcgcgaatctttgataaaatcaattgattgctgaccttggttagtcattgcagcaatacccaatgcagcaacacatagcacaactaacagcaatatacgaacaattaatgaaaagtattctgcaaaataggtatttccaatagctgctattgttaataatgaaattgaaaatacccataatacattatttatacctttacttttgacacccttttctactttatccagggttatgttttgaatttctttagccatatacaacctaaaatttattacaaaagtgaatattcaattataaatcgcgcaattctaacattttctgctggtgttgccacgatcttttcacaaatttcttgtgaatcttattatttttttgagtgttacaaggattttcaagtacgttattactttgcactataaccttgtcatctatttttagaatcattctaaaaaaataccataaattcaatctgtgataatttcaactagtaagcaaaaataaagcacatctacccccttccccccacagtaatcttatccaacttcaccgtaggttgcccaacgccaacaggtacagattgcccttctttaccgcaagtgccgatacctaaatccagttccatttttttaccaaccattgacacctgttgcattgcttcgataccactgccgattaaggttgcacctgtgactggtttggtgattttgcctttttcgattaaataggcttcggacgtagagaatacaaatttgcctgaggtaatatctacttgtccaccactgaagtgaggggcgtataaaccaaattccaccgactcgatcatctcgtcgaactcgtgattgccttctgtcatataggtattggtcatacgaggcattggtaaatgagcataagattcacggcgaccattacccgttggggcaacgcccattaaacgagcgttgagtttatcttgcatatagccttttaaaattccgttttcaatcaatacattacgttgtgaaggcacaccttcatcatcaacggtaatcgaacctcgcatattcggtacagtaccgtcatcgacaatggtacaaagtggtgatgttacaagttcgccgattctgcctgtgaacattgatgattctttgcgattaaaatcgccttctaaaccgtgtccaaccgcttcgtgcagtaaaatccctggccagccagcacccagcacaatcggcattgagccagcaggtgcagcgaccgcacctaaattcacaaccgcttgtcgcactgcttctttagcaaggtagacggcacgactgtcgcctgtatagtgtgttgctaagaaccattccaagccaaagcgtccaccagcccctgcactgcctcgctcacgtttaccgttctgttctactaataccgaaatagataaacgtactaacgggcgaatatccgcggctaaagtgccgtccgttgcagacactaacatttcttcatatacggcagacagatttgcgttcacttgaattacacgaggatcttcggctctcgccactttatcgactaaatgtaatagttcaactttctgttcacgacttaaggtatcaaggggattgatcgaggcatagcgtttgatagcggtcgtttctttgaaaggttttaccaacaaccgaccgctttcttgcgtgatactacgagctgccattgcacattgctcaagctggctaagcgaaatttgatcagcataagcaaagcctgtttttttccctgacaccgcacgtacaccgacaccacggtcgatataaaaaccgccttctttgataatgctatcttctaacgaccaactctcatcttggctaaattgaaaatagagatcggcatagtcgatttgacggctagaaaaatgatccaacactttcgtcagatcggataattgaagtccgctaggtaacagtaaactgtttgaaacttggtttaacattggttttctctaaataatgataggcggtgagattttaacggatttttacaaatgatagggaaatttttaggggaaagatgatttgtgatatacttgacccgattatctgttttatccaagaagttttacaatgcgagatcctcttcaatattatttccttgaaatgcgagagcattatctaaatgtaccttatctcaaccaacaacgccgaatccgtgtgcttttacccaaagggtatcgtgaagaagcaggtcattatcccgtgttatatatgcacgacggacaaaatattttttatagcaaagagtcttattcgggacattcttggaaagtgattcctacgattaaaaatcacaaagaatttccaaagatgatcattgttggtattgacaatgcaggccctgatcgtcttgatgaatatggtccgtggcgaacagacacaggctctacccctgaaacccaaaatgctggaggatatggaatggcgtatgggcgttgggtggttgaaacggttaagccttttatcgatcaacattaccgaactaaacgtgatcgtgatcataccctacttgcaggtagctcaatgggcggtattatcactgcttatatgggcgcggaatatcctgaagtattcgggcatttaggcgtattttctcttgcctcgtggtttagtgaacctgcctttatggaatttattcatacacacccactcaaccgctcaagcaaagtgtttattcaagtgggaacgaatgaaggcgatgaagtggattcacattttatttcaaatatgaatcaggcttatattgactgtacgttgcattattaccaagcactaatccgcacgggacatcctctcgataatattcgtctaaaaattatggcaaatgaaatccaccacgaaatgcactgggcggatcattttgtcgagtttttgcggttttcgttgatgaatcattaaaaagttattggaataaatacccaacacttctatacatcatttcagattatctatatacgctataaagtataaaaatcatagttatactttacagcgtatatttcataaattatacttcacttagtataaaataaatttggaagaaatatgttaatcacgacaccagatatgcttggaaatagcctacgcgatattcgtaagcaaaaaaagctttctcaaatgcaaatagcaaatcaagtagctttaagacaagccacgatttccacctttgagaaaaaaaccgataaagccactattgaaacattattcaagttactttcaggtttaggctatgaactacatatccaacctcgtcctgaaaaaacagaggggaacgatgaatggtaatgcgattacgagtattaatgaatggcgaaatggttgggtattttgaccgcactttatcgggttcccaccattttacctatgctgaaagttggctaaattccccattagctcgcccgatttccctttctatgcccctgcaaagagcaacatatcaaggcaaagaagtgattaatttctttgataatttactgcccgataatcctcaaattcgagcaagaattgcgacaagatttaatgctgaaacacaacaaccttttgacttacttgctaaaattggtcgcgatgctgcgggtgctattactcttttaggggaagatgaacaaattcctaatcatcgaataattcaagccacagaattaaacgagagtgaaatggcgaaaattctacaaagttatcaatacaatgtcccacttggtatgattgataataatcaggacttcagaatttctattgctggtgcacaagaaaagacagctctgctttggcataacggcaaatggaaattaccacacggattgaccccgacaacgcatattttcaaattgcctatgggagaaattcgtacccctaaacacctgcttgatctgtcaaaaagtgtagataacgaactcgtctgtttgagattattttctgctttcaatatcccttccgcaaacgttgaattattggaaatgaacgatatacgggcattagctgttgaacgttttgatcgccgtcttagtcaagatggcagttattttttacgtttaccttacgaagatttctgtcaggcattcggcttatcgccaacgcaaaaatatgaaagcgatggtggaattggtattggggatatgatgaataagttgctctactccagtaattccaacgatcgccgtcaatttatgcaaactcaatttctgttttggctactggctgccattgatggacacgctaaaaacttttctctcgccattgaaaaacaagggcgttatcacttatccccagtgtatgacgtactttctgcttatccaatgttaggcggaaaaggttggcatcacagtgaattacaaatggcaatgagcttgcgtagcacgcaaaaagggaaaaaatggcattggagtaaaatttatgctgaacatttctatgccacagctaagtttgtcggatttagctcaagtgatatgaaacaagtgatagagcaaatttgcgatacagtgcaagaaaccattgatagcgtagcaacaacactacccaaacagatagatgaaaatgtacgggatcaaatattcacgggcataatgaaacaggtgcaaaaagtttctatgaagtaaccgctattttgctaacaccctcaccaaaacccctaacgcctgttcgatctcttggttccaagcataagaacaattaaccctaatccctttatgctgcgaagtaggcaaggtaaaaagctcacttgggctaatgctgattttttcttcgagcaactcttgataaatctgcatactatccaaatgttcgggcaggtgtatccaaaggaaatagccgctgctgtggtgttcgataggacaacttgcaggcaagtgctgacgtaggtaatccaaacactgctttttgtttttttctaaatgacggcgaaggtgtcgcagatgtttctcgtagtggtgattagagataaattctaccaaggcttgttgaattaaagcgttagcagaaatggtactcatcagttgcaaatgttggattttatcggcaaattgccctgcgtgaacccagcagatacggaagtttgcccctaaaattttagaaaaagaagaacaatgcaacacccagttttgtgcatcaaacgccttcatcggcaagggcttttcaccccgataataaagctcttgatacacatcgtcttcaattaaatgcacttgatattgagctaacaattccccaatccgctgtttgatttcggggctgacggtaaaccccagaggattatggcagttcagaataaaccaataaaccttgatcggataacgctgtaaggcttgctcaaacgctacaaggtcaaaaccgcttgggtggtcgggcgaagtaacaacatttaaacctaacttttccgcaatctgccacaccccataaaataccgtctgctgtaataaaatataatcgccctgttgcgttaaggcttgtagcgaaaggttcaaagcgtctaaacagccggacgtaatcacaatatcatcggcttgcgtaggaataccttgcaagcggtaacgttgtgcgattaatttacgcaattccacattgcccgacaacacaggctgtggctgatctcgcaaagacggcaatttctcgtgcggtttcaactcgcctgtttcaattaaatgtttaaggtgctgggtgagtttggtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggccagccgtttagtcaagcatatttggaaaacgtgttgcaagggtaaggcgagtttgattcaacaaacagtttgttggctttaacggcggtgcaacaaattgcgccagaaaaagagcttgccgtgttggcggcgttgcagacggcacgttatgtggacggcttggataatgcggattttgctgtgattgaacaggtgttgcacaagctcaatcttagccaagctgtgccattgcttagcaaacaatctacccaaacagcattagaacaacgtcttcaattcgggcaacaactcgctaaccattgtggtgtgcaaggcgtgccgcagttgattgtggaaaaagacgatcggttacatattgtgccaagccagttgttgtatggtgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattgatgagcgttactaccgtaagctgaaagtgagtgattggctgagcaaagcggaggaatggaaggggataaaatcggtgttggaggtgtgtcgcaagcggtcagataatgrmaaagaatcrcaagaaaaagtcttttatatcagtagtttggatgttgatrttcaaatattggcgaagtgygtgcgagggcattgggaagtggaaaacaaagcccattgggtgctagatgtggtctataaagaagacgaatgtgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtttaacgatgtcgcaacaagaacgctggatttcaaataaagatgtgacgccagaacttaaacataaattggctgaatgtatttggtggcttgccgtgctttcaaaacgaatggatatagatttaaaacagtctatggaaacttttttatcaggtatggaacaacgtttggggaaataacaaaataacaagcggtgggattttgcatatttgagacaatcccaccgctttgtgttatcaagtcctcaccaacctactcaccacctgccctgctgttttttctttaattacctgccaatgttcaggcaagaccaacagcgagtgatttttttctgtttcgacataaatcaaggcgttttcagccagccagccgttttgttcgagtgccgttaagacttgcggtacaaagccttgatgaaatggcggatcgacaaaaaccagatcaaaaggcatttcgctatttttctgtgcaagaaattgtagggtatccgtttgaatgaccttgccattttcagcttttaggctgactaaattctttttgagttgatttgccgcgtctgcaaatttttctaagaatacgaccgcttgtgcttgacgggataaggcttcaatcccaagtgagccactgccagcaaagcagtccaaacaacgagagccagcaatatccatcatcagccagttaaagagcgtttcttttactcggtcagtggttgggcgtaatccttcggcgtttaatacgggcagttttcgtcctcgccataagccagcaatcacacggacttcgcctgttggtctgttttgtgtagaaattcgagtttttttcatacgaaatcgtaaaaattagggttaaaaatgatagactaatacaagtttattccatttttatcgaaaatggattttttaattttaagagagagcaaaaaatgtcagatgaaaagaagaaaaaaggcttttggtcttggttaggtttcgggaaaaaggaaggcgttgaacaaacggcaacaaccgaagaaaaagtagcagagaaagcagatgctcaaccagaagaaattacggaacaagcggtcagttctgagcaagattttgcaaaaaatgaagagattattgaagaaaatataacgaccgaagacgtggttgaagtaccaactgaagttgtcgaagaagtgattgttgaaccaacggcagaagaannnnntgaaactgtcgagcaagcggttgttgaaccctcagcagaaacgaccgaaagctcagacgaacaaacggaagagttgcacatttctgagcaaaacccaccgcttgtagaagatgaaacgaaacaagatgtggaagatgaacctcaagcggaagaaagtgttcagacagatgaatatcaagaaaaaccaactagtgagggcggttttttcagccgtttaatcaaagggttaattaaaacgaaacagagtattggctctggtttccgtaacttctttagcggtaagaaaattgatgatgagctgtttgaagagttagaagaacagttattggtggcggatttaggtatgccgactaccacgaaaatcattaaaaatttaaccgaacacgccacaaaacagcaattacgcgatgctgagttgctctatcagcaattaaaagttgaactggctgatgtgttaaaacctgttgctcagccattggtattagaagataagaagccttatgtgatcttgatggtgggcgtaaatggggtcggcaaaacaaccactatcggtaaattagctcggaagttccaagcggaaggaaaatcggtgatgttggcagctggcgatactttccgtgcggcagccgttgaacagcttcaagtgtggggcgaacgcaatcacattccagtcgtggcacaaagtacgggggctgattctgcgtcagtgatttttgatgcaatgcaatcggcggcggcaaaagggattgatgtgttaatcgcagataccgcaggacgcttgcagaacaaaaataacttaatggacgagttgaaaaaaatcgtgcgagtaatgaaaaaatatgatgaaaccgcaccgcacgaaattatgcttacccttgacgcaggtacagggcagaatgcgatcagccaagcgaaattgtttaatgaagcggtgggtttaacggggattaccttaacaaaactggacgggactgcgaaaggtggggtaatttttgcgattgcggatcaatttaatattccaattcgctttattggcgtgggtgaaaaaattgatgatctacgcccatttgatgccgaagaatttattgaagccttatttactcacgaggacgagaagtaatgatccgatttactaatgtcagcaaagcctataaaggcggtggacgaccagctctgcaagggattaacttccaccttgcagaaggggaaatgaaatatatcacggggcattcaggggcaggaaaaaccaccttgctgaagctgattatgggcattgaacgagccaatggcggacaagtgatgttcaacggacacgacattacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccttgcagaacgagaattgccgtttttacgtcgtcaaattggtatggttcaccaaaattatagcctactgagcgaccgctcgattttagataatgtagcattacctttgatcattatgggcgttaatcaaaccgttgcagaacgtgaagctcgccttgctcttgctcgtgttggcttggaaaataaagcgaacttccgaccgcttaatctgtcaggtggggagcaacaacgtgtagatattgctcgtgcgattgttcatcgtccgctgttattacttgctgatgaaccaacaggcaatttagacgacaaactctcttttgaaatttttcgtttatttgaagaatttaacaaagcaggcacaacagtattgattgccacccacgatacaaacattatcgcccaacgccctaaaccgtgtttagagttggaagaaggacatttaaagtaaggatcgacaatgctaaattcacttaatgctcaaacccgttttattctgcgttcagtgtggcaagatctactcaaacgtaaatttggcactttcttaacggtattagttattacggtgtccttaacgataccgaccgtcagctacttgctatggaaaaatacgagccacgcagcgacggaattttatccagagccagaattgacggtctatctacataaaaacctagcagaacacgatattaatgcagttgttgaacgaattcgtcagtttgataccgataaggtggacacgctgaattacatttctcgccaacaaagccttgatgaatttcgtacttggtctgggtttggtgaggcgttagatattctagatgacaatccactgcctgcggtggtggtattaaagccgaagaaaacctttacctcacctgaaaatatgctggagcttcgcaatggtttgcagaatattaaaggggtacaggaagtgcgtttagacaatggctggttagaaaaactcacagcgattacccaattaattgctcgtgtagcggttacctgtacggtgttgatgcttattgctgttttccttgttatcagtaacagcgttcgttctgatgtgtctaatagcaaagcgtctattgatgtgatgcaactattgggggcgacggatcattttatttcacgcccattcttatatattggaatgatttatggcttgctcggaagcctactagcgatgctatttagtttaatgactatcagctattttacaggggtagttcgttatgtatcagatatgtttacggtaaaatttgaactacacggctttgatgttagtgaggcgatttttattatggcactgagtatctttcttgggtggttatctgcgaagattgcgacgaataggtatattcagaaaattggtggaaagtggtagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaaaattagcaaccattttgtctactatgcccttttttatagatagacgttagaaaccaatggttctaccatctggatttctcggatcagagtagccataaaatccatcttctctcgcttgaataatctgaattcttcccataggagctttaacattaattttatgtcctttttgctccaagagtttgagggtatcaggactaattccttcctcaatgcgtaactcatcaggtaaccattgatggtgtacgcgaggagttacaatcgcttcagctgggttcattccatgatcaacggtgtttaaaatactttgtaacaccgtggtaatgatacgagcaccgccaaggctaccagtcactaaccatggtttatcctctttcagaactaaggttggtgtcatagaagaaagtgggcgttttttcccttcaacagcattaacgtctccgccaattaaaccaaaggcatttgcaacaccaggtttagctgagaagtcatccatttcattattcagaagaattcctgttccttcggcaacaataccactaccgaaattgagatttaacgtataagtgactgctacagcattaccttctttatccatcacggaataatgggtggtttgatcactctcgtaagattgtggttgtcctggtttgatatcagatgctgggcgtgctttttcttcatcaataccttggatgagtgattttgcatattctttagaggttaaccctttcgcaggaacttttacaaaatctggatcacctaaatattcagagcgatcggcataagccaatttcattgtttcagcgagatggtgaatcgttttggcgctattagaaccaaattcatttaatgggtagttttctaacatattgaggatttgtactaagtgaatcccacctgagcttggcagtggcattgtcacaattttgtatcctcgatattcaccagtaatcggtttacgttcgacggcttgataacctttcatgtcatctaaggtgatcaatccattatgtttctccatctcagcaacaatctttttcgcaatgtcgccttcatagaaggctttagatccctcttttgcgatttgacgtaatgagtttgccaaatctgtttgaactaaacgctcaccagctattaatggtctgccatctttgaaaaagatttttttactgctttcccatttacctaatgtttccgtttcttcttttaatgtacttgctaaggtgccacttaccacaaatccttcttcggcaagcttaattgatggctctagaatttttctagtggcagacttccccattttttcaatgcgtattccatgcctgcaactgttcctggaacaccaacagcaaaatgggtgtaaagtgatttgccatctacaacattacctttttcatccagatacatatctcttgtagctttaattggtgccatttcacgaaaatcgactgtgaagttttcgccactttttgcatcatgtagtaccataaaaccaccaccgccaatatttcctgcatttggtaatacaacagctaatgcaaaaccgactgcaacagcagcatcaacggcatttcctccttgtttcaaaatatctacgccaatttgtgtggcaagttcttgctcagaggcaaccataccgtgttttgcataaacaggatggaaaatatctttgctactgtcataacgctgggcagcaatttgcctcattgtaggctgtgtgtttgcaagtagctctgtggatagaggcaaggctaatgccacagtcaaactgctaagtaagaaatattttttcatggttttatgcatcatatatactccttggtagtggctaattaaacaactttcattatgcataaattaaacaaaaatnnnnnnnnnnnnnnnnatttataacaattttattaacagagaataagacaagcggttactttcatgaaaaattttgcaaactgggcttaatagcgtgctatgatcattaagcttatatcagcatttattattaaggattcctatgaaactttattatctaccgggcgcttgctcatttgttccgcatactgcgttagaatggattggtaaaccgtacgaagcggaagcggtcaaccgtgacaaaatcaaatcgccagaatacttggcgttaaatccgcaaggtgcggtgccgcttttagtggatggtgatttcgcactatcacaaaacattgcgatcttaacttacctcgataaccttcatcctgaagcgaaactgtttggtagcgatacagcacaagacaaagccaaggcaatgcgttggttgtcattcttcaattcagatgttcataaagcctttactccgttttttcgtgtaccaccttatgcacaaggaaatgaagctttaacggtagaaattcgtcaaaatgcggcggacaatatgttaagaatgttagaaattgccaacgatcacttagagcaccacgcctttttcggtgaacgtctctgtgtcacagatgtgtatctctacaccatgttaggctgggcgaaacgtgttggattggatgttagccacctcactcacttcaagtcctttatcgaacgtgtcgaagcggataaaggtgtagatgctgtacgtgttcaggaaggcttaaaatagaacataggcgagaataattctcgccttttctctttcattctatctgttttttgattaaatcgatcagaagaggaaattcacaccatccttccctatctaaaaaatgcccacctgacggtaagcgaatataatctgctttcaaatgtttggctaattcatcactatatggatgtgggacaaccgtatcatctaacgcggcaacaacataagacttaaatgctaaacagcttggtgcaacagcataactatttgaaaacgaactcagttcaggaatcgtatccaatggctgataaaatcctgacacaaaaatagccgctttaggttttaaaaagtttctcgccaaaaagttaagccaagcgatacagcctaaactatgtccgacaacgatagtctcatcatcaatggtgatgtgtccttccaaatgtctcagccatttatctggatttgggttacttgaatctggcatattcaagcgataacactcaaccccgatttttgctaattcttgttctaaccacggaaaccaatgtttatccgccgatgcagtataaccgtgaacaatatagacttttgccataaaacctcctcaatacaagcggtctgattttgccataaatttgcaaaaataggtaaataacgaaatattttaaattagtgtaacttagactaataataaattaacattcatactgctaatagattcttgggcattttctagtaatcctttatcgcaaatgatctggtcaaatacggtgagaggatatacaaaaaaagtcgcaaattttccatatttagaagaatcagtgacaagaatatttttacgagaggcttctataattgctagtttcacaggaattttgttttcattaggcgtggtgagtcctttaagattccatgatgaagtcgagataaatgcgatatcaatagataagttttttaagaattgtgcggcaagcatgcctgttgtagataaattttctttacagacacttccaccaatgtgaatgatttcacatcgacctgagttactaagaaaatgagcgataacaaaatcattagtgataactaaaatgtcattgcgttctgctatttgatgtgcaatttctagtgtagttgttcctgcatcaaggtaaatcgtggcattatgaggaatctgttttgctgctgcaacaccaattgcccatttttggtcgtgaaataattgagatttatcactatgcgtgggttccgtcgtcagtctctcaagtgattgaaccccccctgatactgatgatattttcccttcttcttccaatttttgaatatctcggcggatagtcatatgtgagacatttaaacggttggcaagaaaattaacgcttgtactgccaaaactattaacaatttgaataatctgtctttgtctttctgctggaatcatattctttccttacattatcttcggcctgttcattatacccatctatgttaccttgagctattaacaaaatttaacaattttgttaaattttgtgagctttgtcacagattttatttttattgttatgtatgatttgtaaacataatttatgagacatcattttatggggagttagttatgagtaaatctacttatagtatcgcagtaattgggcttggtgcaatgggaatgggggcggctaagtcttgtattacaaaaggattagatacctatggtattgatctgaattctaaagcgttagaaacactaaaatcctttggcgcaactgatattggggagagtgccattccttttgcatctaaattagatgctgtattactacttgttgtgaatgctactcaagtgaaatcaattttatttggagagaagggactagcacctcaccttaataaaggtactgtggtgatggtttcatctaccatttctgcccaagatgctaaagaaatttcacataaattaacagagttagggttattaatgttagatgcacctgtttcaggtggggcagctaaggcagctaatggtgatatgactgtgatggcatctggttctaaagaagcttttgagaaattagagcctgtgttagatgcggttgcaggaaaagtttataacattggtgaagaaattggacttggagctacagtcaaaataatccatcaattgttagcgggtgttcatattgcagcaggcgctgaggcgatggcattagcagcaagagcgggaattcctttggatttgatgtatgacgtggtgacaaatgctgcaggtaattcttggatgtttgaaaatagaatgaaacatgttgttgacggagattatacaccattatcaatggttgatatttttgtcaaagatcttggtcttgttacggataccgctaaagtattgaaattcccacttcccttagcaagtactgcgttcaatatgtttacatcggcaagtaatgctgggtatggcaaagaagatgatagtgcagtgattaagatcttcgatggtatcgagttaccaaaaaagggggataaataaaatgttaggcgttattgcagatgattttactggggcaagtgatattgccagttttttagttgaaaatggattaaagaccattcagatgaatggagtgccaacatcaaatttagtagaacctgttgatgctgtagttattagtttgaaatcacggtcgaatccagttaatgaggcgattgagcaatcattagatgcgttgaaatggctacaaaataatggcggaaaacagttctattttaaatattgttctacttttgatagcacagagaagggcaatataggtcctgttaccgatgcattacttgatgcattgggtgaggatttcacaattatttgccctgcattaccaatcaatgggcggaccatttttaatggttatctctttgtcggaaatgtattacttaatgaatcgggtatgcaaaaccaccctatcacaccaatgaaagatgccaatcttgttcgtttaatggatatgcaggcacgtgagaaaaccggtttagtaagctgtgctgaattattcaaaggtgctgactatgttaaacaacgttttatggagttaaaacaacaaggctatcgatatgctgtagttgattcagtggacaatactcagttagctgttttagcagaatcgattgaaagttttaaattagtgacgggtggctctgggttggctgcatatatggctgaaagaatttcaggcggtaaaaaaggtactgatgcctttacgccaaccaaggcgaaaaccgttattttatcaggatcttgttctgtgatgactaataagcaagttgggtattatcagaaacatgcacctagctatttcttagaggctgaacaagctatcaataatcctgaatatgtagaacagctctaccaatgggtgatttctcacttaaaccaaccgcttgctccaatggtatatgcaacagtccctcctgaaacattaaaaacaatccaagcccaatttggtgcagagaaagcgagtcatgccatcgaaactacctttgctcgtttggcagaaaaacttaaagatacaggcatcactaactttattactgctggaggagaaacatcgagcattgtggttcaacaactaggttttgctggtttccatattggtaaacaaattgcacctggggttccttggctaaaagcggtagaagaaccgatttatttagcattgaaatcaggtaactttggaaaagaggatttctttaaattcgctcaggagatgtttgtatgacggatttggcacaaaaaatccaaatggttgaacttgcgaaatcattatttgatcgaggatacacagtaggcggtgctggaaatctttctgtcaagcttgatgataatagggtgcttgtcacacctacaggttcatctttagggcgattagaagttaatcgtttatctgttttagatatgaatggaaatctcattgagggtgataaaccttccaaagagtctgtatttcacttagcactttatcaagcaaatcctcagtgtaaagcggtagttcatttacattcaacctatctcacagctttatcttgtttgcaaggaattgatactacaaatgcgatgagagcttttacaccatactatgttatgagagtgggacaacttcctgttatcccttattacaagcctggtgataccaatattgcaagagagttgagtgaaagagcattacaggctaaagcttttctacttgccaaccatggtgttgtagtaacaggaaatagtttagtggatgcagtggataacacggaagagttagaggaaactgcaaaattatattttattttgcaagggaaaagtattcgctacctctctgagagtgaagtgaaggatttggaaaatagggggaaataaaaatgcctaaatttgctgcaaatttaacgatgatgttcaatgaagtaccttttttagacagatttgaagctgctgctaaagcaggatttagatatgttgagtatttatggccttatgaatatgacaaagaggtattaaagcgcttattagaccaatatgagctgaaacaagttttatttaacactgctgcgggtaatgtatctgctggtgaatggggtgtttctgcaataccagggcgagaggctgatagccataaggatattgatatggctcttgagtatgctttagcgctaggttgtgaaaatgtacatgtcatggcagcagttgtgccagaaggtcaggatagagaagcatataaacaaacattcattgagaatgtgcgttatgcggcggataaattcaaaccttatggcattaaagtattgttagaagcgttaagtccagacgttaaacctaactatctgttaaaaagtcaatttgacaccttggaaattgtagaagctgtgcagagagaaaatgtatttgttcagctagattattttcatgcccagaacgtggatggcaatttatctcgattgacagataagttggatagcaaatttgctcatgtccaaattgcatctgtaccagatagacatgagccagatgaaggtgaaattaattatgcttatattttcaacaaattagatgaaatcggttatgaaggctatgtaggttgtgaatacaaaccaagagcaaatacggttgatggcttgcaatggtttcaaccatacaaaaatcgttaatctatttagatgaaagagaaagaaatgaaagtagtaattacaggtggacaaggttttttaggccaaagacttgctcgtactttattaaatcagcattcagagaaaattgatgagcttgtgttaattgatgtagtaaaaccgattgctccaaatggtgattcaagagttcgttgtttagagatggatttaagaaatccagaaggattagatcaaattattacaaaagaaacagatgctatttttcatttagctgcaattgtgagtagccatgcggaacaggatccagatttaggttatgaaattaatttccttgcaacaaggaatttattggaaatctgccgtaaaaataatcctgctgtacgttttatattctctagttctttagctgtttttggtggtgagttacctgatgtaattgttaatggaactgttgttactccgcaatctacttacggtacacaaaaagcaatgtgtgagttgctaattaatgattacagtcgtaaaggatttgtagatggtattgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgacagcgtatgggttaaacgtgtaaaaatagaatgggacggtgtagagctaattagcgacaataaagaagaataccgcccaatcagaatatcagcagatgaagctcaaaacctacaaatcatcgggcaagtggttcatattgggcatagcctaatttaaaaatttaaaatgggttttaaaatttcttaaacccattttaaaaaccgatcaaacctgcccaaacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggttataaaaaagtaatctgcactcaaaaagttggactaaacaaccaactgattaatgtgtagattttttatgaccaaatataacaaactattcaaacaacaagtaatcgagttttatcctcaaaatggcaaaaatcgatctctcactcatcggcaatttcaactcaaagacacaacgctatgtcgttggatttcaaaatataatcataatggaatcaatgagttagaggttgtcagcaagaatcaaaatgagggcttaaagccttgtagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccaaataaaaacaacctgtatcaaacaagaaacacaggttgttatatcaatcttgtactaaatcttcgaatatatctcagctattgccaatattttttctttgaagtttgtccgatacctgggttaaaactatttgttggatcaagatgttgatagaatttacgtaaagtaggttttgcttcatacaaatgtcctacattatgctcagcaggatactgggcaccacgttggtcaagcaattctaacattttatgctctaatgctacgcagtcatgaccttttttcacaatataatcctgatgaaaaacatggcacataaaatgaccgtaatagagtttatggctaattttatcgttgatctctgttggtaatacttcaaaccattcactatcattgcggcgcaacgcaatatctaaagcaacaatatcctctacctctttttcatgaatagctctgtaacgtactgccgcagaagcaacagcaaatctgtgaagcattgccgcttgagtttcttccgaattacattcgaaataaccacctttagcactttctgcgaagtaggtttttaaatattctcttgcttctgtaacacctcccccccccattttaacgattaaatgatgttcatatttatctcgatattgacgaagacttaaaggtaaatgctgtggtaatactttagaaattaattgtaatgctttatcactcaaatggttaggtaaaaaatgatattttttagctaaacggtctactctcgcttttagtgcgaataacattggtaaacgatgagtacccagctttttaattacccaaaatgtatctttaccatattctgcagccatatcaaaagcatcacgatgaatatattctcctgaaattggtaactgctgaaaattagctagcatataacggcgaatatcattaagaacttcagttcgatttgttccaatataaaatacagccgtttctttttctgcaggaaaagtatctaaacgtacagcaaaaatagctaacttccctgcacttccggatgcttcataatgacgagccggatcagcattaaaacgagcgggtgaatcttcgtctatttgacgaacatgattacagtaagcatgatcatgtccttttccacattctagttgaatatccttacgttgataacgctgttcttgtagattttgtaaaatctcttcaggtgtttcacctaaatcaatccctaagtgatttttaagttctaattcacctttttcatttaattgagcataaagtgccatttcggtataagccggtcctcgttgtactaaagcccctcccgaattattgcaaacaccaccaataaccgatgcaccaatacatgatgagcctattacagaatgtgcttctctattgtgaggttttaatgcattctctagagcattaagagtagaaccaggcaaacacacaacctgactcgcattattaataagttgaattccattgattctcattgcattaataatcacgatatcccgatcataatcatcgccattcggtgtcgaaccccctgtcaaccccgtatttgcagcttgggtaatcactataacatcagctgcaacacaagcctttaatatttcccaaaactctagtaatgtcgctggacgtacaacggcaagtgcatttcctgatccaaaacgataaccacttcgataaacttctgttttggaggcttcagtaataatatatttctcccccacaatttgagtgagtgtactaataagcttctgggctgacacataaattccttatattggttaataattaacaaaattataacataattgtagaaatatctacattatgaagtcaaattcaacgaaaaaactcaattttttccaccacacttttataaacttgaaaaagattaattgggttaaaatcccttagttttgttttcccgaacaaaaagcaaaaaccccagtatctctactagggtttaaattaatgccctgatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagtttttttctaaatgttttgtttttcaccaaaaattaaaaacagcaaaacataacccattgattttaaacaaaattatttttcagcaaaattcagtatatttaagcgtttaaatccccaattctgcattaccttttctctttttaggaagtcttcactgttttgcgtacaaaatgcctgattttctttgttttcgttattcacattcctcttcacatcttgtaataagctcactacacggttcgcaatccgatttccagaatcaacaaaaaagctcacccgtggtaatagttgttgcaactcttctttgactaatgggaaatgtgtacaacctaaaatcaccgtgtctaatgtcgggtgtgattgccattctgcaacaactttttgcaggcgttgcatatccaccgaccccgtttgctgtttttcttcgacaatttccaccaagtctgtggaaccaatgcgttctaccacacaatcttttgcatagcgttcaatcaactcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacataaggacgagttaccgtgcctttggttgcaagtaagccaatggttttggtttgggaaatttgggcagcaggtttaatcgcaggcacagtcccgacaatcggcattgcaaaccgttctcgcaaggcaggtagcaccaccgtactggcagtgttacaagcaacaaccaccatatcaagcggatagttttctgcaattttttgcacaatacctaccgctcgttcgatcagcaccgcttctgatttttcagaataagggaaatacgcgttgtcaaaacagtagagataatgggcatctggcagattttcacgaatagcatcgtaaatagtcaaaccacccattcctgagtcgtaaagaagaattgttggtttcattatattttgtaattaaagaacttcgagcgaatgctacgcctttcttgatgtggtttcaaatgaaaattgtggcagaaaaagctctcgaatttctaacggataacctttgagtagcaatgttgaacggcgagcatataagcccgtctgcttgtcttggctccattccaaagttaaacgctgtggattttgcggaaatagccacaaaccaataggattatctcctagggttaaaacggcttgtgctacattctcaattgtttcttccactaatagcgtttgagcaaaaatccacgctttatcatcaccacttaacaccacttctcgcacccacgtttttgcaaaatattgctcaaatccgaccgcttgccagccctgttgaacaacttcaacgtctagcctttgacaaatttgttgcaacttttcggttaaagagttcgtatgtaacagccattctgcaacttgacttggcaaacccgtttccgccgtctgccaagttgatgtggctaataaggttcgatactgctcgaaatcctgcatttaagcccctagctgtttgagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatctgctctaacacatcatagccttgctgagtaaagtgcaatccgtcgtgacacaggtttagatccaatttgccttcttcattagcaaaggcattccacgttttcacataacgaatatcggaagggcaatgtgcttcaaggtattgatttaacgccaaaatcgcaggattgtctgtggtcgcaatgttattcacaggggttgcttctaataaatagtaacgagatgttggggctaacgttttaaaggcggacacaatctcgttaatccagcctaacacttgcttcggcgaataatcaggttcttttacaatgtcattcacccctaaaaagataaacacatcttcgcctaactgtttgattaaattacctttaacaatcaaatcaaggtattgacgagtgctagtaccagataaccctaaatttgccaccgttttacctgcaatattcggcgtgccttgttccatatcagaccacatatcaaatagtgagtgaccaacaagggtaatttgagctgttttatcaaactcagtctgtttgcttaatgccctgtctaaaatgtcttgatctgttttcatatgttatcctttgtctaaagtaatgattaaaaaccatcctacacaacaaaccccactttcttatacacttccgctaaggttgctttcgcttttgctctcgctttttctgcaccttcacggtaaatactttcaagcaatgcttcgttgttacggaaatggtgataacgttcttgaagttggcttaacattgcggaaacttcgtcggcaacggcagtttttaagtgaccgtacattttgccttcaaattctgtttctaattctggaattgtcttgcctgtgacgcttgccaaaatatcaagtaggtttgatacgccaggtttattttgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtcgtaacgtacaacaggtggctcatcaccgtcggtcattgcccgtttgatttttttcgccactgattttggatcttctaataaaccgataacgttattacggttatcatctgattttgacatctttttcgttggttcaagtagcgacataattctcgctcctgttttggcaataaagacttcaggcacagcgaagattggctcaaggacatttccctctgcgtcttttttgccgtataacgcattaaaacggttagcaatatcacgggtgatttctagatgttgtttctgatcgtcgcctacaggcacttgatttgcttggtacagtagaatgtctgccgccattagcactggataagtaaataagcccacgtttacgttatcttcgtggcgagctgatttgtctttgaattgtgtcattcgccccatttcgccgaagtaggtataacagtttaagatccaagcgagttggctatgttcaggaacgtgggattgaataaaaatagtgcttttgactggatcgataccacaagcaaggtaaatggcgagtgtatctaaggttgctttgcgtaacgcttctggatcttgtctcactgtgatggcgtgtaaatcgacgatacaaaatagacattcatattcatcttgcattttaacccagttacgtaatgccccaaggtagttacctaaacttaattcgcccgatggctgtacgccactaaatactattggttttgacataatctttctctttttagtaaaaaatctagcggtgtgattttggcagaaatttgctaaaaatgccaagtattcaaccgcttatcatttaaggaattaatcctcaatccccaaactttcccagatttcatcaacacgtttgacgacatcgggatttttggtaatcggcgttccccattctcgttgggtttcacctgcccatttatttgtggcatcaatgcccatttttgagcctaatcctgcgataggggacgcaaaatcaaggtaatcaatcggtgtgttttcgattaatgtcgcatctcttgctggatcgcaacgagtggtaatcgcccagattacatctttccaatctctcgcattgacatcatcatcacacacaatcacaaatttggtgtacataaactgtcttaaaaatgaccaaacccccatcattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcctgcgtattgctttttgatcgtgactaccgctaggcgataagaacagccttcgggcggtaagtagaaatcaacgatttcagggaattgcttctgcaaaatcgggataaacacttcattcaaggcttcgcctaagaccgcaggttcatcaggtggtctgcccgtgtaggtggaatgatagatggcatcttttcgcattgtaatatgcgtcacggtaaacacagggaaatactcttgttcattgtaatatcccgtatgatcgccgtaaggtccttccaatgcggtttcgttaagatcgatatagccttcaagcacaatctcagcactggcaggcacttccaaatcattgctgatggatttcaccacttcggttttgtgtccacgcaataaccctgcaaatgcatattctgataaagtatcggggatcggcgtgacggcggctaaaatcgtagcaggatctgcccctaatgcgaccgaaacaggaaacggcttatcgggattagcttctttccactcttggaaatccaacgcaccgccacgatgcgatagccaacgcataatcaatttatttttagtgattaactgctggcgataaatccccaaatttaaccgctttttataaggaccttgcgtaatggttaagccccaagtgacaagcggtgcgacatcaccttgccaacagtgcataatcggcagttgatacagatcgacatcatcatccgagatcaccacttgctgacaatctgctttattcaacaccttacttggcatattcagcacttgcttccactgtggcaactgtccgattagatctttaaagccttttggcggttcgggttcttttaagaacgccaacaacttgcctagctctcgcaaggctttggtatcttcttgtcccatacccattgccacccgttccggcgtgccgaatagattgcacagcacaggcattttgtagcctttcgggttttcaaataagagagccggaccacctttactcaaagtacgatccgcaatctcggtcatttccaaataaggatcgatctcttgagtaatacgcttcagttcgcctttttgctcaagcagatcgagaaattctcgcaggtttttgtatttcattggattctccattgcaagaaaatgcaattttaataaaatttctaatctagagaaataaaagagctgaccccagtatgatactgaaatcagcccattaaaactatctatttaaagatatagccacactatttggaatataatgcaataaatacaactaaactatttacttaaattatcaaagaagtttttcacccctttgaaaaaaccttcgtgttttggtcgatgttgccctttgccttccagactttcttctaatttacgtaacaactctttttgttcttcattaagcgatactggggtttcaataatcactttacagattaaatcccctgcatagccacctcttgcactggttacgcctttaccacgcacgcggaacagtttgcccgtttgggtttcggctgggattttgagtttcacgcgaccgtctaatgtcggcacttcaatttcgccacctaatgccgccattgtgaagctgatcggtacttcgcagtaaagatttgagccgtcacgcacgaaaatatcgtggtctttaacgtgaattaccacatataaatcccctgctggagcgccgttttcccctgcagccccttcacctgataagcgaagttggttgccagtatccacgccagctggaatggtgaccgaaaggtttttagttttctcaacacgtccgtcaccgtggcaagatttacacggtttctcaattttcttacccgtgccgtgacaacttgggcagacagtttctgtcataaagaaaccttgttggcgacgaactcgtcctgagccgtgacagtgtggacaggtttcgactttgcttcccgcttcagcaccagaaccgtggcaagtatcacattgaacaagagttcgaatgcgaatatcttttttcacaccacgcacggcttcttcaagggtgatttcgagatcgtagcgtaagtcatcaccacgtacgacacgttggcgacgagcgccaccaccaaaaccaccgccaaacatttcgctgaaaatatcttcaaagccaccgaaaccgccaccaccaaatccgccgaagccaccagctccgccaccgtgttcaaaggcttggtgaccatattggtcgtacatcgcacgtttttcgttatcgcctaatacttcataggcttctttgatctctttaaatttttcttcagcttctttgctgccttggtttttgtcagggtgatgttttgccgctaaacgtttataagcacgtttaatctcttgttcactcgcccctttttgtaagccaaggacttcgtagtaatcttttttactcatagtattttttgtaaatttttaagaaaatttgaccgcttgtaacctaatttcgttatattctgttttctaatgaaaaaatctgcttatttagaatttcatcaattttggctcgttccaaccctgaatttatcaaagtgagttctaacgttttcatttgttgtttaaatgcttcttttgctttatgtacattttcagcaataaaatcagcattgagatcgctttcgatacgataaaatttaatgttggaaacacaaggataaaaccaatcaaatttagcagttaaatcctgaatagcaatagtgccatgtgcttcactaataccttctttccccaaataaacacttccttgtagatgttcaaaaccgtgtttttcaagcgtatttcgaatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtagtaagcgttattatgggtatttccatggtaattatcttttagacaatttgtatccatatcaaaagtgattaggtatctactcatattcaatttccaatagttagattttatctaaaatgttttttgatgataattaggacataatcaacgcagttttcaacggtatcatcaccatttaacttttgagcctgtatttcgagttttctttcgtagatatacaccaaaagggcgtgttgccacgccctttgtagggacgcagtgcctgcgtccgtggacacacgcagtgtgaccctacccgtaaattacttgttgtctttcacttcttcaaactcagcatctaccacgccgtcatctttttgactttgttgggcttgttgctgaccttgttgagcctgagcttgacctgcttggattaacggctcagacgctttcactagggcttcgattttcgcttcaatatctgctttatcttcgcctttcgccgctttttctaatgccgctaccgcttcttcgatcttcgctttgtctgcatccgcaaggttgctacctgcttcagcgatctgtttacgggttgagtgagcaatcgcatccgcttggttgcgagtttgaactaactcttcaaacttacggtctgcttctgcattcgcttccgcatcacgcaccatttgttcgatttcagcatcgcttaagcctgaagaggcttggatcttaatttgttgctctttacctgtgttcttatcttttgcagacacattaataataccgtttgcatcaatatcgaatgtgacttcgatttgtggcataccgcgtggtgcagggttaatgccttcaaggttgaactgacctaatgatttgttatcagaggcacgtttacgttcaccttgtaatacgtgaatggttaccgcactttggttatcttccgccgttgagaacacttgcgattttttcgttgggatcgtggtgtttttctcaattaaagttgtcattacgccacccattgtttcgatacctaatgataacggggttacgtctaacaataatacgtctgttacatcacccgctaatacgccaccttgtacagccgcaccgatagccaccgcttcatctgggtttacgtctttgcgtggttctttgccgaagaagtcagccacttttttctgtactaatggcatacgggtttgaccgccaactaagatcacatcgttgatctcagatacgcttaaacctgcatcagctaacgccacttttactggctctaatgagcggtttactaaatcttctactaatgcttctaatttcgcacgggtcacagttaatactaagtgttttggacctgttacatctgcggtgatatacggaagatttacttcggttgattgtgctgatgaaagctcaattttggctttttccgcagcttctttcacacgttgcattgccattgagtcattgcgtaaatcgacgccttgctctttttgaaattcttcaacaaggtagttaattaaacggttgtcgaagtcttcaccacctaagtgagtatcaccgttggttgcacgcacttcaaaggtttgttcgccatctaagttatcaatttcgatgatagacaagtcgaatgtaccaccacccaagtcatacactgcaacaatttggttttcttttttagagtctaaaccgtaagctaatgccgctgctgttggttcgttgatgatacgtttaacttctaaacctgcgatacgacctgcatctttagttgcttgacgttgagcatcgttaaagtaagcaggcacagtaataaccgcttcagtcactggttcacctaagaaatcttctgcagttttcttcatttttttcaatacttccgcagagatttgcggtggagccattttttcgccttttactgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctccattgtccgctttggtaatctcaaacggcataatttcaatgtcacgttgtacttcagaatcagtaaaacgacgaccgattaaacgtttaatcgcaaataaagtatttttcgggttagtgatcgcttggcgttttgctggctgaccaactaaggtttctttgtctgtatacgcaatgattgacggagtagtacgcgcaccttctgcattctcaattacacgtggtttgtcgccatccattactgcaacacaagagttggttgtacctaagtcaataccgataatttttcccataatttgattcctctaatataaatttggttgtttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaagaaacgggaagttgtgctacgttcccgctcagacggaacaataaatagggataaaaatgtgggcttcaaggggaaaactaaaaaaatttaaaaaatgtgtattaacacacacgcactatttctcactacggcacaatcaccgtaaacacataagccgccatattaaccaaaagcactacgccataaagcatattcgatttgccgtgattaagagaaaccatcacaacgaaagcggacaatgccagtagcaccattgatttccaatctaagcctaacaccatattaatatcaaatagtaagcagacgatcacaacagacggaatagttaaaccgatactggctaacgctgaacctaacgccaaattcacactggtttgtaatcggttacggctggctgcggtcaatgctgccaaaccttcaggcatcaaaacaacagcagcaataatcaccccgactaaagataacggcgcacctgcagcaaccaccattgtttcaatcgcagaggaaagccctttcgccaacattacaacgacacctaaacagatcaccaatagcaataaactgactaatgccactttagtcgaaggtggctctgcgtgatggtttggattatcatcatcggctaagaaataatcacgatgacgcacggtttgcatcataataaaagagaaatataaaacgagtgacgcaatcgcaacaaataccaactgagagctggtataagtcccccctgccgagctggttgtgaaattaggcaaaatcattgttaataccaaaatagacactaaggtcactaaagcggtactcactgattttttatggaaaaattgaacgtgatgtttaatgccgccaattaataagcaaccgcctaaaatcccgtttaaaatcaacataattgctgcaaataccgtatctctcgctagataggtagcattgtcaccgcctgcgatcatcagcgacacaattaatgccacttcgataatcgtaatggcgagtgctagaataatagtaccaaacggctctccaactttatgtgccacgacttctgcgtggtgaaccgcagaaagcacgctaccaatcaataacgcaccgcccccaagttgtagccaaatgttctctttcacgccaacaaaatagatagcccaagctgcaagcggtaagatcaccgaccaaattggcaaaggggaatgggaatgtgtcgccataatgtcttctcctttatttttatcatttaacaatcctgctcttttgtactcataatctcaataatttgtctatccatatagaccatactttttgtcgcaatcgcacataggttattgattgatttatcaacgctatgttccacgataccttcattgccagtcactcggctattatctaacgccattaacaccgctttgtaggcagatgatacccctgttgaaactttcattgcacagctgtttgctgccccgtcacacaatacgccactgatgtcgccgatcatactgcaaatcgccatactaatggcattaaaattgcctttcaacaaatacgccataccagcagcactgcccattgccgccgtagtcacggcacaaagagcggatagttttggtaatttactgtgaatatagatcgcaatagtatgagaaagaaataacgcacggatcagttgctcatcatcagcattcacaaagcgtgccacaatcactgacggcattgttgccgcaataccttgattgctcgatccagaattgctcatcgcaggcaacaacgcaccgcccattcgagcatctgacgctgtcgtggtttcaatcacaatacgtgataataaatcatcagacatcaagccaagttcaatctgttttttcaaagttcgtccgatatgcaaaccatactctttttccaaaccttctttagataacgcagaatttaatttagccgcttcggcaataaaggcaatctgttcaagaggaacttccatcgcaaattgataaatctgttcggcggaaagttgattgaaaaagtgataatcgtctgctatttcaaccgcttgcgtttgttgctggaacaacacttccccatttttctcaatcaacaccacattggtatgggtatcttgaatacagactttgacccaacccgtttcgcctaacaacaaggcttccgagtaaagcggaaaatccacatttgcaatatctacactcacttggtttgcatctaacatcgctttcgctttggcgacatcgtcagcttgaatatgtttcaacacttccaaacctgccgttgcatcacctgcaatcgccccacagccgccacaatcggcaatcccaccatacctgttccaggtacggtaacccccatactgtttttcattaaatttggggacactttagcctgaatttgaacaggctcactgcccaaatgtgatttcgcaatcgcagacgctaacgccaacgaaatgggttctgtacagcctaatgctggggcaacatctcgtttcacaatggcgattaattgttctgcaaattcaaatttattcattcttttttctctttagtaaaatttctctctattctaaccgcttattgcataatcaaaaagtaacttttttcacttgtctttagttgaataaaaatgcattattttaacataattatttattatgataatgtctgaatttattttttataattatcacttgaacgcaaacgtttgctctagtaaacttagtcgcctattcctgagtaagagattaggcagcttgcaaaatgacagccaaaaatttcaataattaggagtacatataatgtttgaacctgccattttagttcttgccgatggttctgtttttcatggaaaatctattggttatcaaggacataccattggtgaagtggtctttaataccgcaatgacgggctaccaagaaattctcaccgatccttcatacactaatcaaattgttacattgacttatccacatatcggtaatacaggaacaaatagcgaagacgaagaagcagataaagtgtatgctgcaagtttaattattcgtgatcttccccttattcatagtaatttccgtgctaactcttccctttctgattatctcgttaaacataaaatcgtcgcaattgccgacattgacacacgccgtttaacccgaattttgcgtgataaaggcactcaagcaggctgtatttatgttggtgatgatgtggctaaagctctcgaacttgccaacagtttcggctcaatggcagggcaagatttagccaaagaagtgacctgtaaagagctatatcaatggaaggaaggcgaatggcaactcggcaaaggttatgtgcaacaaactacccctgaatttcacgttgtcgcttacgattttggcgtaaaacgtaacattttaagaatgcttgctgaacgtggctgtcgtatcaccgttgtgccagcaacaacttctgcagaagcggtattagccttaaatccggacggtattttcctatctaacggtccgggtgacccagagccttgcacctatgcgattaccgctattcaaaaattattggcaaccaaaaaaccgattttcggcatctgcttaggacatcagttactcggattagccgctggtggcaaaacgaagaaaatggcattcggacaccacggtgcaaaccaccctgtgcaagatttagacacacaaaacgtgctgatcaccagccaaaaccacggttttgaagttgatgaagccagtttgccagctaacgttcgtgtcactcaccgctcactctttgacggcacagtacaaggcattgaactcaccgatcaatccgcattctcgttccaaggacacccagaagccagcccaggtccacacgatgtggcatacctgtttgaccgctttattgatgaattgagaaaggcgaaagggtaataagcggtgaggtttgaagggaaatttgcaaaatcttgtgaagatgtgaccgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcaacaacagagaaaaaactatgccaaaacgtacagatataaacacgattttaattattggtgcaggtccgattgtgattgggcaggcgtgtgaatttgactactcaggggcgcaggcgtgtaaggcgttgcgtgaagaagggtataaagtggtgttggtgaactcaaacccagcaaccattatgaccgatccgaatatggcggacgtgacctatattgagccgattgagtggcgaacagtagcgaaaatcatcgaaaaagagcgtcctgatgcgattttgccgacaatgggcggtcaaacggcattaaactgtgctttagatttatctcgtaatggagtgttaaaacagttcaatgttgagctgatcggggcgagtgaagatgcgattgataaggcggaagaccgtggtcgtttcaaacaagcgatggaaaaaatcggtttgtcttgcccgaaatcttttattgctcacacccttgaagaagccttgaaagtacaggaagcggtcggtttcccaacattaattcgtccatcatttacaatgggcggttcaggtggcggtatcgcttataaccgtgatgaatttttagcgatttgcgaacgaggatttgaagcgtcaccaacccacgaattgttgattgaacagtctgtactcggttggaaagagtatgaaatggaagtggtgcgtgataaagaggacaactgcattatcgtttgttcgattgagaactttgacccgatgggcgtgcatacgggcgacagcattacagtcgcacctgcacaaactttgaccgataaagaatatcaaattatgcgtaacgcttctttagccgtgttgcgtgaaatcggcgtggatacaggcggttcaaacgtgcaatttgcgatcaaccctgaaaacggcgagatgatcgtaattgaaatgaacccacgtgtgagccgttcttctgctctcgcttctaaagcgacaggtttcccgattgcgaaagtggcggcgaaattagcggtgggttataccttaaatgaactacgcaacgatattacgggcggtttaattccagcttcttttgaaccaacccttgactatgtcgtgaccaaaattccacgctttgcctttgaaaaatttgcgaatgcagacgaccgtttaaccacacaaatgaagtcagtgggcgaagtgatggcgatgggaagaactttccaagagagcttacaaaaagcgttgcgtggcttagaaacggggatttgtggtttcaacttgttatcggaagagcctgaaaaaatccgtcgtgaactggcaaacccaggcccgaaccgtattctttatgttgccgatgcctttggtgcaggttttagcttggacgaagtacatcactattcaaaaatcgatccgtggttcttaattcaaattcaagatttagtgcaagaagagcttgcccttgagaaaaaacagttaagcgatttagatcgtgaagaattgcgtcgtttaaaacgcaaaggcttctcggataaacgtatcgctcagctcaccaaagtcagcgaaaaagcggtgcgtgattatcgccataccctcggcattctgccggtttacaaacgtgtcgatacctgtgcggcggagtttgcttctgatacggcttatctctattctacttacgaagaagagtgtgaagcgaacccgtctgatcgtaaaaaagtgatgattttaggcggtggtccgaaccgtatcggacaagggattgagttcgattactgctgtgttcacgcatctcttgccttgcatgaagctggctatgaaaccattatggtgaactgcaaccctgaaaccgtttcgacggattttgatacatctgaccgcttgtatttcgagccattaacgttggaagatgtgttggaagtggtgcgtgtagaaaagccgtggggcgtgattgttcactatggcggtcaaacgccgttaaaactggcaaatgctttacacgaaaacggtgtgaacattatcggtacatcagcagacagcattgatgcggcggaagaccgtgaacgcttccaaaaaatcctacacgatttgaacctaaaacaaccggctaaccgcacagctcgtaatgcacaagaagcggtggcgttggcaaatgaagtgggttatccgttggtggttcgtccatcttatgtacttggcggacgtgcaatgcaaatcgtttataacgatgaagaattgaacaaatatatgcgtgaagcggtgtctgtgtctaacgacagcccgatcttactcgaccacttcttgaacaatgcgattgaagttgatgtggactgtatctgtgacggtgaaaacatggtaatcggcggtattatgcaacacgttgaacaagcaggtatccacagtggcgactcggcgtgttctctacctgcttactcattaagcggtgagatcctcgatgaaattcgcagacagactaaagaaatggcgtttgctcttggggtgaaaggcttaatgaatgtacagtttgcggtgcaaaatgatgtggtatatgttcttgaagtaaaccctcgtgccagccgtaccgtgccgtttgtgagtaaagcgacaggtcagccgttagccaaaatcgccgcacgagtaatggcaggggaaagccttgcggaactcaatgcccttgaagaagtgattccacaaaaatacttcgtcaaagaagcagtgttcccattcatcaaattcccgggggtagatacgattttaggccctgaaatgcgttcgacaggggaagtaatgggtgtaggagaaacctttgccgaagccttctttaaagcacagctaggcgcaggggaacgtattccaagaacaggaaaagtgttcttatcggtggataacaacgacaaacctcgcttactcgatgtggcaaaacgtttacaagagcaaggctacggcttatgtgcaacactcggtacagcgaaattcttgcgtgaaaacggcgtggcagctcaaatcgtcaataaagtgcgtgaaggcagaccgcatatcgtagatgcgattaaaaacggcgaaattgcgatggtcattaataccgtaaacggtgaaccagaagtgattgccgacagccactcaatccgccgtactgcactgcaacagcgtgtacctgtctataccacgattgcaggagccgatgcgatttcctatgctgttgaacatatcaacgaatttgaggtttattcggtacaggagttgcatagtaactagattataaaaagaagagcttgaatatactttacaaaactaatgttattcaagctctttactaatctatttagacagattattaatatggatattaggcatagtacacaattttaataaataataccccaatactgcggagatacctgaaccgattaagattcctaaacgagcaagagagataaattgaccgtcagcttcatcgccaccaaaagcaagtcctgccaagaacattgacattgtaaagccgataccacaaaggatagaaacagcgaagatttgtttaaaattaattccctcagataactgtgcgatacccaatttcacggcaaggaagctaaagctaaatacgcctaaggttttacctactaataaacctaacgcaacccccattgtaagcggtgagaataatgtgcttaagctcattcctgctaaagatacgccagcgtttgagaaagcaaatagcggtaaaatcacaaacgaacaccacggtgcaagaatatgttcaaaatgagccaatggttcttccccatttttaccttttaatggaacgcagaagccaataattacccccgctaatgtggcgtgaacccctgattttaatactgaagcccataaaattaatccaacgaccatataagcacaaattgccgtaactcgcatacgattcattatgattaaagcagtaattgctatgactgctgaaatcagggctgtggtacttaattcgtgagagaaaaagatggcaattacgacaattgcccccaagtcatcaataatcgctaatgcgagtaggaaaattttcaaagcaaatggcactcgtttgccgagtaatcctaaaactccaagtgcaaatgcaatgtctgttgccatcggaatcgcccaaccttgctgaaattctggcgaatcactattaatcaatgtgaaaacaagagctggtacaatcattccccctaatgcaccaatagcggggaaaattgcacgttggtagctagaaattgctccaaccatcatttcatgcttcacttctagccctataaggacaaaaaacactgccataaagccgtcgtttacccacattaacaacggtttatgaatactgaataagccaatctggatactgacaggcatacttaaaaaatcaaagtagaggtctttcaagggcgtatttgcaaacagcattgctaacattgcaaaagcaagcaataaaataccgcttgcagactctagttgtaaaaattttcggatatgctggatcattctgttaacctcttgttatgtaaaattcgtcaatctttcttaaatctttttttcttttaacaaaatcagcgtgtaagatcaaggcgaagagggcagatactgcagaaaatttgtaaaatttgtttgatcaacttcacgaaaagcagcaataaaagatttgaatttatgtttggggaaatttctagattagccttgatctttttggtatttatcgctagaattgcaactcttttttatgatcctcgtttggcttatagtcaatttttaatttttaggtagatagcaaatgaaacgtacatttcaaccatctgtattaaaacgcgctcgtactcacggtttccgtgctcgtatggcaactaaaaacggtcgtcaagtattagcacgtcgtcgtgctaaaggtcgtaaaagcttatctgcataatggcagataagtcagccaaaacactcagtgtgaataagctaactttttctcgggagctacgtttgttagctcccgttcaatttaaagcggtttttgaactgcctctccgtgctagcacacctcaattaacccttttatctcgccaaaacgatattgaacacgctcgaattggtcttaccgttgctaaaaagcatttgaaaaaagctcacgaccgtaatcgtattaaacgcattgtgcgagaaagcttccgcttgaagcaacatcaacttcctgcttatgattttgtctttgtggcaaaaggcggaattggtaaactaagcaaccaagaattatttgaaaccttggataaactatggcaacgccacattcgcctcgctcagaaagtacaacaggaacagcatcaaaactaagtcttttggcttatgtaatgctcgcccttgtgcatttttaccgctatgtcatcagcccattaattggaccacgctgtcgtttttatcccacttgctctacctatgcgttagaagcggttaaaattcacggtgccataaaaggtggctggcttgtgctaaaacgtattttacgttgcaatccattgaacgaagggggggaagatcctgttccgccgaagtgtaattgcggtaaaaaacataaataatattgtaggtcaggcagtaatgctcaacttaatctatcttgcccaataccaacttacccgcaaaacgttgcgttaattgattttgaaacagttctacttgtgtggggttaatcgctaagattaattccaccttatcactaaattgttgctcaagtagctcaatatcccgttccgcaatcaaatgttgaatcgtattaaattgttcatattcacactgcaagcggtaagatttacctaaaactttgcgaattttttcgacttgcaatagcccctgttgtacaccattgccataggctttaacgagtccgcccgtgccgagcaaaatcccgccgtaataacgaaccgccaccgcactgatttcccccaagcctgaacctagcaagtaattaagcattggtttaccagctgtccctgaaggttctccatcatcagaaaagccatattgctgtgaatcattcggctgccctgcaaccgttgcccaacaatgatgtcgagcatgcggatgtaaagctcgtatttcagcccaaaaggctttggcttgttccattccttctgtatggcgaatgtaggtaataaaacgactttttttgatctcttcttcaaagatcacttctgctttggggataaaaaattccatattctcaactggttacttcatagagttctatcatactttaatgatgagatttgataaatctctttcaaattgttaaaaaaatgtgaaatcattcaagtttttaagagaaaacgtttgcataacagaaaaaagtcgagtatatcttatatcgttttcctatttgagttataggtcaaacgcaacatcttacttttcccaatcctgaatttttagaggaaatagacatgaaaaacttttttaaattatcgttagttgcaagtttagcaatgggttctatggcagctcacgcagaggacaaattcgtcactatcggtactggtggtcaaacaggcgtttactatgtagtgggtcaatcaatctgccaattagtaaaccgtgacatagcaaaaacgaatgtgaaatgtaatgcgccatctacaggagcatctgttgcaaacttgaatgcaattgctgataaacagatggaaatgggtattgcacaatctgattggcaatatcatgcttacaacggctcaagctcatttaaaggcaagaaaaacgataaattacgtgcagttttctcaattcacccagaaccatttacagtcatggctcgtactgatgccaaaattgctaactttgatgatttaaaaggtaaacgtgtgaatgtgggtgacccaggttcaggtacacgtgcaacgatgaacgttattttagcggcaaaaggttggacagataaagagttcaaagtagcttctgaattaaaaccagcagaaatggcatctgtaatgtgtgataacaacttagatgcaattacttataacgttggtcacccaaacggtgcgctaaaagaagcggcagcatcttgtgatgcacatttagtgccagtaaccggcgaagcgattgataaattagtggcagatcactcttattatgcaaaagcaacgattccgggcggtttatataaaggtaccgataatccggtagaaaccttcggtgtgtatgcaacgcttgtgacttctgcggatgtggatgccgatcgtgtctatactgtggtgaaagcggtatttgataacttcgatcgtttcaaacgtttacaccctgcgtttgaaaacctaaaagaagaagagatgatcaaaaatgcgctctctgcgccattacatgaaggtgcaatccgttattataaagagcgtggttggatgtaattcatccgtttcttaatattaaggcaggagtaaatcacttcctgccttttgtcgttttcatcaagcggtcagatttggctgattttttgcaaatttttcgttaaatctaaccgcttgtcttgggttttctcggaggagtttatgtctgctcaatccaaaactatggattacgatgatctgcaagatctcgtcgcctcaaatgattcaggcggtcgtaacccgacaggttttagtaaaaaattaattgttattacagcgattttatggtcgctattccaaatctattacacttcaccatttccattttggctacaagaagtggtgagagattggggctggaatttgaatgtggtggtagatgataccaaagcacgttctatccatcttgcctttgccatgttccttgccttcttgtctttccctgcctttgcaacatcgccgaaatatcgtattcctttccaagattggttatttgcaaccctcggagcgtttcttgctgcgtactacatttttttctatgaagggctagttacccgttttggtgcgccgaatacgcaagatattattgctggctgtttaggcattttattattgttagaggcttgccgtcgtagtttgggtttgccgttagtgattattgcgactgtatttttgctttacaactattttggacaatttttaccgagcagttctatcatcagccaccgttctggttcattatcccaaatcattaaccaacaatggatcaccacggaaggggtgtttggtgtcgccctcggtgtttcaaccaaatatgtgttcttgttcgtgttattcggggctttattggataaagcgggagcaggcaactacttcattaaaacagcatttgcttatttaggtcactttagcggtggtccaggtaaagcagcggtagtttcttctgcgttaacgggcttggtttcaggttcatctattgccaacgtggttaccacaggtaccttcaccattccgatgatgaaacgtgtcggtttgagctcggaaaaagcaggggcgattgaagtggcttcatcagtgaacggacaaattatgccgccggtcatgggggcagcagcgttcttgatgattgaatatgtcaatatgccgtatagccaattgattgtgcatgcgttcttacctgcattaatttcttatattgctttggtgtatatcgttcatcttgaagctcaaaaaatgggcttaaaagggttggatcgtgttgaacctgtcagtccgattttaatcactttgcttaaagttgtaagctatattttagtaacacttggcttagctattgcggttcattacggcttaggctggattaaagatgttgcccctgattttgccttcttaattgtgtgtattttattagcggcggtctatatcaaattgattcaccgcgtttcacaattccctgatttagaagccgatgatccaaattcactggtcgtatcattaccacgtcgtaaaccaactgtgaacgctggcttacatttcttattacctgttgtggtattaatgtggtgtttgatgattgagcaattctcaccagggttatccgctttctggggaaccgttgcgcttgcggtcattttagtcacacaacgcccattattaagtttcttccgtaatgatgcaggtaacaaagttgtgctagttaaacaaggcgttcaagagttagtggacggtttggagtcgggtgcaagaaatatgattggtatcggtattgcaacagcaaccgcaggtatcattgtaggtgccgtatcgctcaccggtttcggagtgcaactttctggtattattgagatgctctcgatgggcaatatcttattaatgctgattttagtcgctatctttagcttaattttagggatgggattaccgactacggcaaactatatcgtggtatcttcattgatggcattggtgattgtcgaagtcggtaaacagaatggattaatcgtaccattgatcgccgttcacttgttcgtattctacttcgggattatggcggacgtaacgccaccggttggcttagcttcttttgcagcagctgccatttcaggcggtagcccgattaaaactggggtgcaagccttctactacagcttaagaacagcgattttaccgttcctatttatcttcaataccgatttactcttaattgatgtgggttgggcaaaaggtattnnnnnnnnnnnnnnnnnnnnnnnnnnnnnnntgctctttaccgcagggacgatgaattacttcttcactaagaataaactatgggaaannnnnnnnnnnnnnnnnnctgcctttatgttattccgcccaggcttctttatggaacacatttcaccaacttcacgccatattgagccttctcaaatggttcaggagttagagaaagtacccgctgggcaaaatctcacattgaaagtcgcaggagtaaacccttatggcaaaccgattgaattctactcacagcttacagtgcctgaaggtgcaacgggcgaagagcgtgtcaaagcaatgggattaaccttgttggataccggagagaaaattgaaatcaacggcgaaatgtcaccgaagatcttaattgataatgttgaaattgattcaccggccgctaaagcaggtttaaactgggatcaaaccattcttgatgtagcgttaccacaaaactcgcttccaaaagaattaatgtttattccggctttcctattagcgatttttgtcggttggaatcagcgccgtcgcatgaaaaaataaggacaaattatgtataacaaacttctccttgcgatcgacttaaacgatctcaatagtgctaaatatgtggttgatacggcattaaaactcacagggaacaattccgatgcggtgtatcgggttgtgaccattatcgaacccattgacgacagctttatttctgcttttctaccaaagaacttcgacaagtctgtgatagcagaagcgaataaagccttacatgcctttactcaagccaacttcccagagggctcaaaggttcaacatattgtggctcacggcaccatctacgaagagatcaaccgcattgccgaagaaaaatccgttgatctgatcgtgatgttggcaagcagtaaacctaatgcaaaaggactgagctcaaatacggtaaaagtcgctcgaaatagcgacaaaccaattttagttctgcgttaggcaatcaatacaagcggtaggattttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttattttttcgatctgcgtcgaaaaatgaaaaatatcaacttttcttcttatacctgctttctataatgccttttcatttatttcaagggcagatttatgttacatctagaaagctatcaaaattggttaaaatcactcaaatatcacattcatcattcccagcaacgagctatgcttgcggtgaacagcgaaatggttttgctttattggaaaatcggacaagaaattttacagcggcaacaaagcgaagggtggggagcaaaagtcatcgatcaactttcacgagatctcactgcagaatttccagatatgaaaggcttttccagccgaaacctgaaatatatgcgaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgaacaagaacgcctttggtatgctcgcaaagcaattgaaaatggctggtctagaaatatgctggtacatcaaattgaaggtcagctattttaccgtcagggtatagcaatcacgaattttgacaaaaccctgccagatacacagtctgatctagcaaggcaagcctttaaagatccctatattttcgactttttaaatttaacggaacaacgccacgaacgtgaattagaacaggctttaaccaaacatattacacaatttctattagagcttggtgctggatttagttttgtaggaagccaagttaagttaaatgttgggggtgatgatttctatattgatttactgttttatcacttaaaattacgctgttatgttgttattgagctgaaaacttgcgatttcaaacccgagcatatcggacaacttaatttctatttgactgtcgtcgataaccaactaaaaacagagatagatacgccgacgattggactattgttgtgtaaaaatcgcaataaagttgttgtggaatatgctttacaaaataatccattacccattggcgttgcagaatatcaacttcagcaactgttggctgaatttgatatggaataaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggcatagcaaaaaatcactgctatgcctaaattttgtaaataatttgctcaatcccaccgcttacccttcaaagggattaaacaacttcacacctgtgcgagcaaaatcagcggaatttcgagtgactagcgttaagttatgttgaattgcactggcggctatccacgcatcattttcgggggcgtgatcagggatatgtaatttggcacagatttgggcagttttttcgtctattttcaggattttgccatcaaaagcaggtttgatctcaaattcaaaccagtggcgtaacatttcaccttgcagtgtatccttatgctcgattgccatcacaccacgttctaattccatcatcataactgcactagtaaacatcaactcttttgatgttgtcattacccactgtgccaccccttgattacatttacctttaggtaattttctaatttcactgattaaattagtatctaataaatacattttttcccctactcagtaaaatctacaggacgacgttgagctttgctgcgaggttgcaactcaaattcaatatccgctacattaggattacttgggcaaagtgcatctgcaatactcacaaacggcttcgcctgctgtactttttcatattcccgatatgtcattaacacaaatgcaggtgtaccacgattggtaatgatcacaggttctagcatagcggctttttgagcttggctagaatgttgattaaattcacggctggttataactggcattttgtactcttttaatgtagataagtagttacaatcttactgcgattggcgaaataggacaagcgtaaaaagtggaatatgatttatacagtttaattactcttattttgtttcagcgttcaaaccatttttacgctacaataatgccattcaacaaaatgacttttgattatcaacaatgaaaaaactcaacattatttttgcaggcacacctgattttgccgcaacccatttacaagccttgttacattcggaacataacgttattgctgtttacacacggccagataagcctgctgggcgtgggaaaaagctacaagctagtccggttaaacagttggcggaagcgcaccatattcctgtgtatcaaccgaaatcgttacgcaaagaagaggctcaggtagagttacagacgttaaatgctgatgtgatggttgtggtggcttatggcttaattctgccagaagcggtgttaaaagcgccgaaatatggttgcttaaatgttcacggctcgttgttacctcgttggcgtggggctgcgcctattcagcgttctatttgggctggtgatacggaaacgggtgtgaccattatgcagatggatattggcttagatacgggcgatatgttgcataaggtgacaacgccgattttagcgacggaaacgtctgccagcctttatgccaaacttgccgaacttgcaccacccgcattgcttgaagtattaaacggtttaacaagcggtcagtttaagcctgaaaaacagcaagacgagcaagcgaactatgccgaaaaacttacgaaagaagaagcaaaattagattggaatatgaccgcttgtcagcttgaacgtaatatccgtgcctttaatcctgccccgatggcatatttaaccttgatggtgaatgaggtggaagagcggataaaagtgtatcaagcggaagtgctaccacatcaagagaaagcggtcggcacggtattggcggtggataaaaacggtatccaaattgccacgcaacaaggtgtgttaaacattacccaacttcagccagcaggcaaaaaaccgatgtccgtacaagattttttaaacggacggggggattggtttaaggtaggaagcgttctctaatgaaaaaacattccactcgtgccgttacggcacagattattttacaggtgttggatcagggcaaatccctttcaaccttgatccccgaagcacaatcgcaacttgatagtaaagatttagcgtgggtacaggaaacgacctttggtatttgccgtgtgttgcctcgtttagaagcgattatcaaattattggtagaaaaaccgctgaaaaacaaaactcgcttggtgcattgtttgcttttggtgggcttgtatcagctactttatatgcgagtaccgccccacgctgcggtagatgaagtggttaattcgacaaaagtgttaaagttagatagctttcgagccttgactaacggggtgcttcgccgttttctgcgtgagcaagaagcaattttggcgaaagtggataaacattggcaaacgctacaccctgaatggttggtgaataagctgaaacaagcctatccgaattggcgagagattgttgatgcgaataaccaaaaaccgccgatgtggattagggttaatgctcaacggactaaccgagcggactatgtggcattgttgggtgatcttgcaaaaaatcacaaagaagcgaccgcttgcgtgcctgattgtgccgttttattagataaagcggtgtcggtcagccagcttccccactttaagcaaggctgggtggcagtgcaagatgcacacgcacaatggtctgccgaattacttgacgcacaaaatggcgagttgattttagatgcctgtgcggcaccggggggcaagacaacccatattttagaaaaagcaccgcaagcaaaagtaattgcattagatattgaagaagcccgtttagttcgggttaaagaaaatttagctcgtttaaaccaaacggcaacggtgatttgcggtgatgccagccagcctgaacagtggcttacaagcggtgagatgttcgataaaattttacttgatgccccttgttctgcaacgggggtaatccgtcgtcacccagatattaaatggctacgcaaagaagaagatattgctgagttggcagaattgcagggaaaaattctcaaagcactttgggcaaggctcaagccaaacggtgtgttgttgtatgctacttgttctgtgttaccagaagaaaacagtcagcaaattcagcactttttagctcaaaccccagaggctaaattagtcgaaatcaatgtgggtggcgagcaatgtttaatgaagcaattctttcctaaacaagatgggggagatggatttttctatgcgaagttagtgaaacaggcgtaaaacggtgagtaggcaatgaaaatcatcattttaggtgcagggcaagttggctcaacactggcagaaaatttagcgaataatgataatgacatcaccattattgatgatgatcagcaacgtttagctcaattgcaagataagcacgatttacaagttattggtggtaatggggcttcacctcgtattttacgagaggcgggagcaagtgatgcggatttattggttgcggtaacaaataatgatgaaagcaatatgattgcttgtcagattgcatatacgctctttaatgtaccaactaaaattgcccgtattcgtaattcggattatgtccgtgagcgtgataccttatttaataacgccgtattgcctatcgatcatatcattgcacctgaattattagttacacaggatattttacgccttattgattacccaggtaccttgcagattgcccactttgccgatgaattaattagtttggtgagtttaaaggcgtattatggcggtccgctagttggttatcctatttcggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggttatcctatttcggcattaggcgatcatttacctcatgttgaagcccgaattgtgtcaatcttccgtcaagaaaaagcttttattcctcaaggttcaacgattatcgaagctggtgatgaaatcttttttgtctgtgctacgcaacatatcaaagcggtaatggcagaattacaaaggctggaaaaaccacataagcgagtaatgattgtggggggcggaagcattggaattgcacttgctaaagcacttgaggatcgttgcagtgttaaactgattgaacgaaaccaagaaagagccgaaaaacttgcttctaagctgtctaagactttggtgttatgtggcgatgcgtccgatcaagagctgttatttgaagaacatattgagaacattgatttattccttgctttgacgagcgatgatgaggcgaacattatgtcgtctttgttagcaaaacggttaggagcaaaaaaagcgatcgttttagtgcaacgaatggcatacctacaccttattcaaggcggaactattgatattgctctttcgccacaacaagcgacaatttccgctttgtcaagccacgtccgcaaaggcgatattgttcatgtggcttcgtttaaacaaggtttaatggaaggcattgaagtgattgctcacggcgataaagaaagctcaaaagtggttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcaaaatcagcgagctaaaactgccacagggagcaattgtgggggcgattatgcgaaatcgtgaagtgctgattgcccataaatctacggtgattgaggaaaacgatcacattattctgtttgtgaatgataagaaacagtctgccgaagtggaaaaactcttccagttgagtgcgtttttcttgtaataagtaaggagtaatagaactagtattaacttacctatattgtatctaatacaaaatctatttcgcctctctttctagctgagatgtaagtcacaaataacgggcaaatcttcaaaataaaatagttctatgctcgcttccattttatatgctatgttcgtgtaaataacaatggataaaaataattttatacgtcatataaactccactacatatgtgtttaacaacacattctacttatgttatcaatctaaaattaaaataagtactgattttgaatgaaagagtaaatcaaatttaattattggatttctcttttaaccaccattacttagtttttatattgctaagtttgaattattagacttgatttatatcctgtcattattactatttaagaaagttaaattatcaaagtccgaatattcaagtagccaaagtttattttcggtaatttctgacgaaataaataaaaagcatcatattcggaaacgctaaaggaaaactatgcaaagcgtaaaatccgtaagataaaatggtcacaaggagagattactggtaggtacaaaatactaattgtgcataaccataatgagtaaagaaaacgataatattattctgtttataaatgataaaaagcaatctacagaaagagagggaacctcctgtcaaagatggttttatggttctacaaacggatatatcaagatatcttttttcaaaaaatgtgattgtgatcacagaattactttataagcctttaatataatatagacgaaacaggatatttaatagtatatctgatacataaatgcaaccgctgaacgatatattattaataactatttcaatcaactatttataatatattcattacatcttaaaggagaaaactatgattcttggctgcccaaaagaagtgaaagtccaagagtatcgtgttggcttaacccctgcgaatgtgcaatcttatgttgaagcagggcatactgtttatattgaacacggtgcaggtgctgaaattggtttccctgatgaagcatatcaagccgcaggtgcaactttgactgacaaagcaacactctttgcaaaaagtgatatgatcatcaaagtgaaagagccgattgaatgtgaatatcactacttccgcgaaaatcaaatcctttatacctacctacacttagccgcagacaaaccgcttaccgaaatgttacttgaacgcaaaattcaatctgtggcgtatgaaaccatcaaaacccctgcaggtttaccttgcttagcaccgatgagtgccattgcaggacgtttggcgaccttagaagctgcgaaatatatccaaaaaaccttcggtggtgcaggtgtgttactcagcggtacagcgggtacaccaaaagcgaaagtggtgattttaggtggcggtgttgtgggcttaaatgcggctcaaattgcaatgggtatcggggcggatgtcactatcctagatattaacgctgctcgtcttgcttatatcgatcaaatctttgatatgcgtatcaaaacactcaccagctctcgtggcaatattttaagcctattaccagaagctgacgtagtgatcggtgcggtattaattccaggtgctaaagctccacacttactacgtcgtgaagacctcaaattgatgaaaaaaggtgcagtattagtggacgtagcaattgaccaaggcggttgctttgaaacttctcatccaaccacacacaatgaacctatctatgaagttgatggcgtaatccactactgtgtggcaaatatgccaggctgtgtggctcgtacttcaaccttaggtttaactgactcaaccttagaatttggcttgaaactcgcagcactcggtgtgaaagaagcgtgcttgtctgatccagccttattacaaggtttgaatacttacaacggtaaatgtactttcaaaggtgtgagtgatgcctttggtattgcttataccgatccaaaagatgcattaaattaatatcaagctgtgttgtattgatcaagaacattccccctgaataatcagggggatctctcctatccaccatttagggttttccctaaatcaatctcaaattagcggttgtgttagcttgactgagcctactctctgctatttttaaaagaggtatactatgagtgaaaatacaaaacctgaacggcagtcttggtctagtcaattaacctatattttaactgtcgcaggggcgacagtcggtttcggtgcgacttggcgtttcccttatcttgtaggggaaaacggcggtggtgcttatgttttccttttctgtattgcgatgattgtaatcggtattccgatgattttagttgaaaatgtgatcggtcgtcgtatgcaagtcaattccattgatgccttcggtggcagtgcgaatggcaaaaaaatccattctgcgtggaaaattctcggctatatggggctactgggttctgtcggtatcttagcctactatatggtattaggcgattgggtactcacctatatcggtagtttagcaacaggcggcttagatctctcttcgccagtcacaattgaaaccacatctgcctactttaaagataacattcaaaacaatccattaagagttattctttatacgggcgtttttgttgcggtaaactactttatcctaattagaggtattaaaaaggggatcgagcgttctgttaaattactgatgccactactctttgtcttcttaatcattatgattattcgtaatgtcaccttacctggtgcggccgaaggtatcagcttctatcttgttcctgatttttcaaaaatcacaccgaagctatttgtcttcgtattagggcaggtattctttgcacttagtcttggttttggggtattaatcaccttatcaagctacttgtctaaacaagaaaatctagtcaaaaccgcaacaattacaggggttattaataccttaattgcccttgctgctggctttatgattttcccatcactctttacctttaatgttgccccgaacgcaggaccaacattagtgttccaaagcctaccgatagtgttctcacatatgtgggcaggtacaatctttgcgattatcttctttggtttattaatcactgcggcacttacgacatcaattaccatctatgaagtattgattaccgcattgcaagaaaaaaccaaactgagccgtaaacaagcgatcaccttgacgttatttggtatctttatcgtgggtaatattccatcagtacttggcgataacgtttggagcaatgtcaaaattgcaggtatgagcatttttgatgctttcgactacataagcggtaacattctctttgttttaaccgcactaggcagtgcgattttcgtcggctatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttgaaagatgaagcgaagaaagagttaaacaccagtgaaaaattcacaaacatttggtttagctacgtccgttatgttattcctgtactgattattgtgatttttgttaattcgctttaattaggtaatatgaaagcggtgagaaagttgtaaaaaatacaatattctcaccgcttctgtttagtgggtataatagtaaataaaatctaataaaggaggatactactaatctcttaatctatccaaaagctcgggctgagaataaccaacaaggtaaacacttccaaacgcccacaaaccattgcaaacgttaatacccattttgcactgtcgggaatttgagtaaagttactactgaccgtgcctaatgctggcccaaggttattcaaacttgcaatcaccgcatttaatgcatcgaaagtttccataccacaagcaatagtcgccaaccaacagaccacaaatacaaagaaataggctgaaaagaatgcccataccccttccacaatccgctctgataaaacgtgtttaccaagtttaatcggctgaataacatttgggtgaataaagcggtggatttctcgttttccttgcaaataaagcaacaacacacggaacattttcagaccgccgcccgttgaacctgcacaaccgccgataaaagaagcaagcactaataacaacggcaaaaaagagggccactggctaaaatcgttggtggtaaaacctgccgtagtcgaaatagatactgactggaacaaggcttgaataaaagtgacggagtgatcgtcaaaatagttataaatcaacaacaccaataaaaaagcgaaattcgtaatctttccaatacaaaccaagaaaattcgacttattattgcctttgtagcgatcattaaactgatcaaacaccgcaaaatgcagagcgaagttacaggaagagatcaataagaacagtaccgtaatcaagtcaatcatcgggctgttaaagtagccgatactcgcatcgtgggttgaaaatccgccaattgccaccgtggcaaaactatgggaaattgcatcaaaaccgttcatacctgccaaccagtaagcaactgcacacagcactgtcaaagagagataaatcagccacaatgcttttgccgtttctgcaatccgtggacgcattttctgctctttcaacgggccaggcatttccgcacggtataactgcattcccccaatgcctaataacggaataatggctaccgcaagcacgatgatccccattccgccgagccattgtaggaactgacgataaaataaaatcgcttttggcagctgatctagccctgtaattaccgttgcccctgttgttgttaaacctgaaaaagactcaaaaatagactcagagaaattcaaatcagggttttccaacagaataaatggcaccgcccccagcgaccctagcaccacccaaaacagcaccacgattagaaaaccttcacgggaacgtagctcttgcttatattttcgacaaaaccaccacaaagccgtaccgacactgaaattcagcacaaaggcctccaaaaacgcacgaccgccgccgtcatcataaatcaacgccacaaacgctggcacaagcatcgtgaaagaaaaacacatcaccaaaatgccaacaatacgcataattgaaaaaaattgcacagggaaatcctttaaataataagataatgaaatggtactctgcttttcgcacgagtcaaatcatttgaaaaccaagatcttggtttataagcggtgagataaattttgtattttacgaagaataaattttactctgtctttgttctaatttttcaatgaccaaattggtttcaccatattcaatttaggcatactcatttgtttacatcactaattttttcgccatatcttctttcaaccattgattaatttctctcatctctcgaattttatcgtgaatttccattgccgttctaaacaatgctggtttatctgcactgactaagccaaataatacggacgagatagttactgtacttaatagcgtaacaatagaaacactatttgccgccaactttccaaacgtttcaaagcgaactgcatatgcttataacgaaaatgtaaatgatgctctaattttacaaaataagatttgttcaattccacgctcttgaattacatattttatctagctgaaataattgtctaagatattgagctactgcctcatctttattttcaccaatttgctcattatttggtaaagcctgttttaaacgaggatctgcattacccattagacagccttttcctgcttgggatagcatttcaatatcattcattccatcgccaaaagcaatacaatctttcaaagtatagcctcgtaacttgactaagtctgcaagtgtatttgctttacaaacgcctttattcatcatttcaaggcattgaggggtagaataagtaatttgtagtaaatcaccataatgatgtcgcacaaattgctcgacaggtaacaagtcttcaggcgtttttccaataaagaacactttttcagtttttttaccgtgatgttgctgaaaatctaccacttgatacataaagccagagtcttggtgatattttcgtaattgttcgatttcaatattaatgaaccattcatcatcttgatagctattaatgaagactcgcttaggatcaaagggtgtttcgctcattatcttaaaagcaatctcttcaggaatgtggttttgataaagcaactcaccagaaaggctattccctctcgcaccattagatgtaaccaacattgcttcgctgacgccaactttactaataatatgtttaacatcagggtaatttctgcctgtagctaaaaaaatatcgacaccacgttgtgaaagtttgcgtaatgtttcgatagtaaaatcgccaatgcggtgatttgcattaagtaatgtgccatcaagatcagaaataattgcacgaaaaggtaaggtcatagaaattcctttatcattttgaaatggtagtttaagcctaacaaatttattttatcatcgcaaaagaaagcatacattttttgtttgtgattaagctacggttaaaaaatagcaaaataatataaaaaatactaaacatcattttttgctgaaaaaaaatgatatttatgcgttatacattacaggggtttatattaatcactagttagtctaaattttttagcatatttaactattttaattacctaaaaatacacagaaaacgtttgcgacaagtataaaatgctgttgacattactccatttgaagttaatatatgttcaatttctgaataacaatgcaaacataaacacacaactatggtaaaacttttaactcttaacctgctgggattcacgcattctgtgcgaggataaggctcggttagagaaaagttcactatccacacttagcccgcacgtcaaaatgcgggctttttttatcgaatacattttaagaggtactttatatgagcaacaacattattatttttgataccactttgcgtgatggcgaacaatcattaaaagcaagtttaacggtaaaagaaaaattgcaaatcgcacttgctcttgaacgtttaggagtagatgtaatggaagttggtttccctgtgtcatctgctggcgattttgaatcggttcaaaccattgctcgccatattaaaaatagtcgagtatgtgctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcagcagaagccttaaaggttgctgaagcatttcgtattcatacatttatagccacttccgctttgcacgttgagtctaaacttcgtaaaacctttgacgatgtattagatatggcagttcacgctgtaaaacgagcaagaggctataccgatgatgtagaattttcttgcgaggatgcaggacgcacaggggtagataatatctgccgtattgttgaagctgcgatcaaagcaggggcaaccacagtcaatattcctgatactgtaggttactgcttaccaatggaatacggaaacatcattgctaatgtgatgaaccgtgtaccaaatgtggataaagcggtgatttctgtccattgccataacgatttaggaatggcaactgcaaactcattaaccgcaattcaaaacggtgcaagacagattgagtgtactatcaacggtatcggtgaacgtgcaggtaacacagcacttgaagaagtggtaatggcaattaaaacccgccaagccttatttaacggcttagatactcgtatcaatactcaagaaattcaccgtgtcagccaaatggtcagccaactttgtaatatgccaattcaaccgaataaagcgattgtggggtcaaacgcatttgctcactcatcaggtatccaccaagacggtatggtcaaaaataaaaatacctatgaaattatgtcgccagaaactatcggtttgaaaaaagagaagctcaatctgaccgctcgttctggtcgcgctgccgtaaaaaaccatatggaagagatgggctatccagagagcgattacgatttagacaaactttatgaagctttcttaaaactagcggataaaaaaggtcaagtttttgattatgatttggaagcacttgcatttattgatatgcaacaaggcgatgaagatcgtttagcccttgatgtatttaccacacaaattattagtggtttgccagcttcagcctttgtgcaagttgagttagatggtaaacgtgtaagccaagtttcacaaggtggtaacggtcctgttgatgcggtttataatgctattttagcgattacaggtatggaaattaaaatgctcaactataacttaaccgctaaaggcgaaggtgctgaagcattaggacaggttgatattgtcgtagaatatcaaggtcgccgtttccacggagttggtttagcgaccgatattgtagaatcttcagcaagagctttaatccacgcaatcaatgcgatttatcgttcacagaaagtggcggatttgaaggggaaaataaatagtcattttcttaaaaattagcttaagtttatctgtggttgagttaaaatttcgtgatataaaaattttaatatattactgtcattgtataagggaggtcatttttgtttctacttaagaaaaaactttttgaacgcctattgcgttacgttcaaatccacaccacatcagatccgaaaagccaaactgtccctagctcaccgcaacagtgggatttacttcatctactcaaaactgaaatggaaacgatgggattaaccgagatttccgttgatcctaacggctatgtgtttgcaacattgcctgccaatagcgacaaagccattcccgtactcggtttactggctcacgttgatacctcccctgatttcaacggcgagaatgtgaagccacaggttattgagcggtatcaaggcggtgatattttgctaaaaggcagtgggcatacgctatcgccacaggatttcccgaacctaaacggcttagtcggacatacgctcgtgaccaccgacggcacaactttgcttggtgcagatgataaatctgggattgcgattattctgtcagcggtagaatacttgttagcacaccctgaaatcaaacacggtaagatccgtatcggttttactaccgacgaagaaatcgggcgtggagcggatcattttgatgtcaaagcctttggggcagatgttgcctataccttagacggcggaccgcttggggaattacagtacgaaaactttaatgccgatgcggcaactgttacgttctacggacgcagtgttcacccaggcacagccaaaggcaagatgatcaatgccttagagcgagcttgtgagttccaaaacagcctaccgccacatttaacccctgcaaccagcgaagggcgtgaaggctttattatgttgcacgacattgaaggcgatttaagcgaatgtaaaatccactatattttacgcagttttgagcgtgaagaattagcaaaattcggcacttatctcaccgctacaatggcacaaatgcaacaaaaatatggcgaacagtgcggtaaagtagagattgtcgagcaatatcgcaatatgtacgaagtagtcaaagattatcgctatctggtggatattgctgaaaatgtgatgaaaacacagggtattacgccaaacctagagccaattcgtggcggtactgacggctcacgcctatcatatatgggcttaccaacgccaaatatttttacaggcggcgaaaacttccacggacgtttcgagtttatttctgttgatgtaatggaacaggcgacaaatgtggtggtggggattgcaaaagcctttgggggatatccgtttaaatcattatagatattcttataattaaaattatttgtagtaaggatagttacgaataagttatatcttgatcatcatagacctaaaattgaataggcgctaacattgcgcctttcccaaagtaattttttctttatctactaaatatcaaattaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttatttgtactgtttgcaaccttgactatttatttcgctgttttcaggtcttgataatatttctcataaagttcaatcgcatcgcctacatcaacttgccaagggcttttctcaatcacttcgggacgaataaaaacagcaggatcgtcaaccaaatcttttggtaactgtgctaatgccactttatttgctgttggataaccgatagcttttgtcaattttgcagcgacgggagctgaaagcatatagttaatcagcttgtaagctccttccggattttgcgaagttgcaggaattgccaagttatcaatccaaagcggtgtgccttctttaggataaaccatattgattttagcaccttcatttttggcaattcgtacagaaccattccaaagagtaccgatttctacttcaccagaaataaatgagcttgagggattgtcagaattaaacgccaaaatatttggacgtaatttcaaaaattcttcatacgctgcttttaaaatcgcagggtcttgggtattcggatcctgccccatttttaataacgctatattaaatgcctcacgaggatcatctaacaactgtaatttatctttaaactctggtttccatannnnnnnnnnnnnnnnnnnnnnnnnnnnnnnnnnggtttccgtattgtatgcaatccccgttgccccaaaaagttgtggtaccgagtatttattgcctttatcaaaaggacgatcaagcatttgtgggtcaagctcacttaatacaggcaatttgctatgatctaactctttcaacattccttcacgtgccattttagaaacaaaatagctggtgggggcaattacatcataactttgatggtacatattcagaccatgtatagagataaaccgtattcccttccttcgccatgatgtgatgactaccaaaggtaagagttgccgcagataaaaccactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactaaagccatataaaaacttacctaaagatggctatgattttaggttaattgaagctgattgcaacatcttcagtaagatgctgctattctggacttcttatacctactttgcatataatccctcatcatgtaagtataagaaaaaggacgctcgaaagcgtccttatttatctattctttaaaattaaagagcagattttgctttagcaactaatgctgcgaaagccactttgtcaaatactgcgatatcagcaaggatcttacgatcgatttcaacagacgcttttttcaagccattgatgaatttgctgtatgataaaccgttttgacgagctgccgcgttgatacgtgcaatccataattgacggaattgacgtttacgttgacgacggtcacggtaagcatattgtgcagctttaactactgcttggaaagcaacgcgatacacgcgtgaacgtgcaccataataacctttagcagccttaagaactttcttatggcgtgctcttgcaataacaccacgttttacacgagccattattaaatctcctactatttaagcgtaaattaacgctttgacattattaaactaaaaattaactaatcgtacgttgtacttaatttacgcttatgcgtatggtaagcacgctactactaaaacttggtctgctttcgctaccattgatttgtgacgtaagtgacgtttacgtttagttgttttcttagtcaaaatgtgacgtaagtgagattgtttacgtttgaaaccgccagaagccgtttttttgaaacgcttcgcagcaccacgtactgttttaattttaggcattgttaaaataactccgcattgtttatgaataaccagtaattaggcgaatattgttgccaatattacttggaagcactaattacatctcaaggtaatggactatttctttttaggcgctagtaccattacaacttggcgaccttcgagtttgcctggggcagactctactacggcaatttccgctaaatcgtttttaacacgttctagcacgtccataccaatttcttggtgagccatttcacgtccacggaagcgaaccgtgattttggctttgtcgccatcttccaaaaagcgaatcaggctgcgtagttttacctgatagtcgccttcgtctgtacctggacggaatttaatttccttcacttgtacaactttctgttttttcttctgctcttttgcagctttctctttctcgtagatgaacttaccgtagttcataatacggcaaactggtggttcagcatttgggctaatttcaactaagtctaactcagcttcgtcagctttcgctaatgcttcttgaattgatacgataccaagttggtcgccgttttgatcggttaagcgaacttctttcacgcggatttcttcgttaagacgatgtgcgcgatttgtctgaacacgttttacaggtttaatagtactattcctctagtaagtttaagctacgatcataccgcttgcagaagatatgatttctttttataggctcttctaaagagagcaaaacgggcgagattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaggctcttctaaagagagcaaaacgggcgagattttacagaaattcgcctgattatgcaacagacaaaatcatttcattacattctcagcaaaattgttgatattccattataataagcactatcttaattacttaaaccaataacaataatgaaaattctcggtattgaaacttcttgtgatgaaactggcgtggcaatttatgatgaagccaagggattagtcgcaaaccaactttatagccaaatcgaaatgcacgctgactacggtggcgttgtgccagagctagcttctcgtgatcatatccgtaaaacattgccacttattcaagaagcattaaaagaagctaatctcaccgcttcggatattgatggcgttgcttatacggcaggcccaggacttgttggggcgttattggtcggctcaaccattgcacgatctttagcttatgcgtggaacgttccagctttaggggttcaccatatggaagggcatttgctcgcaccaatgttagaagaaaacgcccctgagtttccttttgtcgccttacttgtttcggggggacacactcagctagtcgatgtaaaaaatgtgggtgaatatgaattgttgggggaatctattgatgatgctgcgggggaagcctttgataaaactgcaaaattgctcggtttagattacccagggggggcagcgttagctaaacttgctgaaactggcacgccaaatcgttttacctttccacgtccaatgacggaccgcccaggcttagatttcagcttttcgggcttgaaaacctttgcggcaaatacgattaatgcgaatttgaatgagaaaggcgaattagatcaacagacccgttgcgatattgcctatgcgttccaacaagcagtgattgaaacatttattatcaaatgccgtagagcgttgcaacaaaagggctataaacgtttagtgatcgcaggcggtgtgagtgcaaataaacaacttcgtcacgatttatccgaattaatgaagcagatcggcggtgaagtcttttaccctcgcccacaattttgtaccgataatggtgcaatgattgcctatgcaggtttcttgcgtttaaaaaatggcgaacagacggatttatccgtgagtgtcaaaccacgttggccgatggttgaactttgtcccatcgatgtatagtagacaaagtattataaagggtagattaagatattgtaatataaggctttgagccacttttttgaattatcaggactattcaaagtatctcgaaagcccctaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaccttctttgatcgtgaacttggtattttagtcctgatggatttactttctaaaaaaatggtttgccattgagttatcaaaacataaaaagatgtttattacaggatagcgttcaattttgtctattatgcctttattgattcgatctagaaaaagccgccgcttctgcgattaacgcatcacttggacgaatccccgtataaagcacaaattgctcaactgcttgtaatgtcatcacttctgcaccagaaatcacctgtttgccttgagctttcgcatactgaatcaaaggtgtttcggctggcattgccaccacatcaaaagccgtttgagcctgttgaatcatcatttcggggaaggctaagtcaaactcttcttttccgcccttcataccaatgggggtgacattgactaaaatgtccgcctgttgattttcaagactattgatatattgatagccgtaaagttctgcgagatattttcctgtgtcttgattacgagcatagactttcaaattcgtaaaacctgaatgtttaaatgctgcaacaacggcttttgccataccgccactgccttgcacaatcacacaagcggttggatcgagctgatattttgcaattaatttctcaatcgcaatatagtcggtgttataggctttcaaatagccattggtattgacaatcgtattgaccgattcaatcgcttttgcagatgcatcaatttcatctaaaaatggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaggcttctttaaacggcatagacaccgcacaaccccgaatacctaaggctctcacgcctttgactgcgtgttcaatatctttggtggtaaatgctttataaacaaagtttaaaccgagtttttgataaagatagttatggaaataagtgccagtattgcctggtctgcccgatagggacatacaaagttgagtatctttattgatcataaatttgccttattgaatagaataagtgccattatgctgttttagatgtaaaacaacaaggaagtcgtgaaaaaacaaaagccctgggtttccccaaggctttctttttgcattaacgcataagcgaaaattattcgccaagacgctctttgatacgtgcagatttacctgaacgctcacgtaagtagtaaagtttcgctttacgtaccgcacctttacgtttaacagcaatgctgtcaattacaggtgagtgagtttggaatacacgctcaacgcctacgccgtttgaaactttgcgtaaggtgaatgctgagtgcaagccacggttacgaattgcaataaccacgccttcgaacgcttgcaaacgttttttactaccttctactacccataccttaacttctaatgtgtcacctggacggaagctaggtacgttttgttttaactgttcttgttcgatttgtttgatgatgttactcattttaataaaccttctatgtcctagaattaactgatttgtgtcgtttctttatgttattcaacaacacgcgttgttcgtcagtcagagctaggctatccaatagctcagggcgtcttaaccacgttcgcttaagcgactgttctaatcgccatttgcgaatttgctcgtggtgacccgacatcagtacttgcggtacaggtaagccatctaatacttcagggcgagtataatgcggacaatccaataaaccttctgcgaaagagtcttccaatgctgaagcctgtttgcctaataccccagggataaatcgtgcaacagcgtcaattaacgtcattgcaggaagttccccccctgtgagaacgtaatcaccgattgaccattcttcatctatttcagtttggattaatcgctcgtcaatgccttcataacgcccacaaaccaaaatcaatttttgatttatcgccagagtttgtacaccagcttgatcgagtttacgcccttgcggagagagataaatcactttagcttctacaccgtcttccttacaagcggttgcttttgcttcacgaattgcatcacgaagcggttgcaccatcatcaacatacctggcccaccaccataagggcggtcgtctaccgttttatgtttgtcgtgtgtgaaatctcggggattccaacactgcacttgtaagagattttgttttactgctctacctgttaccccaaaatcagtaattgctttaaacatttcggggaaaagggaaataataccaatccacatattttgacctacgaaatgcgactgctaaagctcactgcatacctgaggttagaaaccagcgtcccaatccactgtaattgttttagtggcgagatctactcttttaactacttgttcatataagaacgggattaaacgttcttgcttaccgaaagcatctttactgccagcttttaccaccaacacatcatttgaacctgtttccatcatttcggtcacagttcccattgcataaccttcaaggtttagcacttggcaaccgatcaaatcgtgccaataataatccccttcttccaattctggaaacacggctaaatccacaccgatctcggcgttggttaatagctgtgcggtttcgcggtcttctgtgccttttaatttcacaatcaaatcattgttgtgataacgccaactttcgagttcaacttgttgccattgccctttaatttttaagaaccacggctgataatcgaaaatgctttcaggatattctgtcgatgaataaaggcgtagccagccacggataccataggttgaacctaattttccgacaacttcaattttttgctcgctcatactcacctacttatttaatttgtggaattaagctgctttacgcgcttctttcactaatactgcaacacgatcagaaagtgatgcacctttagcaacccaagcatcaactttagcaacgtctaaacgtaaacgttctgcgttaccagttgcgatagggttgaagaaaccgatacgctcgatgaaacgaccgtcgcgtgggctacggctgtcagcgacaacgatttgatagaatgggcgttttttagctccgccacgagataaacgaatggttaccataaccgtcctctaaaagtttaatgatagtaaaaaagaaaaccctcgttcgaggtgagggtgcgaaacttgttcaaaaaagagagaacaagcggtcggattatacggattttttgcaaaaaggcaagtgaaaacccttgttttatgtttacaactctagaagaaaatgcaaaacaaaaacctattctcacgacaattattttcattctgtgataggaatgatggatatgaacttatcactttcaacctataataaagaattagatattttgaatcagtgtcgtaaataatcctatcttgttatcttaaacgttatttaaaaagtagcttagttataaaactaagctactttctcaaatactcaaccctcacatttaaactcgctaataaaatcgcaataagcggaattacataattcattacggcgtaaggggcatattcaaatgcactaacttgtagcatagagaatgcataaataccgcaagtattccacggcactaatacggaagtcactgtaccgccatcttcaattgcacgagatagattttttgaacttaagcctttttcacggtaagcatttgcgtacatccgtccaggaagcagaatagaaatatattgttcagcggcagtgcaattagtcaaaatagaggaaagaacagtagcaataataagatgggttgttttgtgggcaatacgaagaatagtttcaacaatggacttcagcattcccgttctctccgcaataccgccaaatgccattgcaataatggtcagtgagatggtgaaccccattgcttcaatgccccctcgattgaataatgagtcaatcattgcattgccactttctattttatagccataatgtagcgtgttcaccgcgacttttatctcgccaccttgtaccacaatatgacaaagccagccaaacaaaatcccgatagttaaagcggggagtgtaggcactttttttgcaactaaaacagcaacaacgagtggcacagttaatagccacggtgaaataacaaagtgcgttttaatggcttgcataatttcggcaattttttcgagttcgacactttgagcattgaactgtaaaccgagataagcataaacaagaagagcaataaggaacgctgggagggtagtgatatacatatagcgaatatgttcaaaaagcggcgtgtgcgtaatgcctgcggcgagattggtagtatctgaaagcggggacatcttatcgccaaaatacgcccccgaaatgaccgcacctgcaaccatcggggcaggaatatttaaacttagcccaatccccattgccgcaacaccgatagttcccattgtggaccacgaactgccaatcgcaagggtcactaccgcacaaataaggcaaattgtcgctaaaaatagagagggcgagatgagttgcaatccatagtagatcatcgtggcaacaatccctccaccaatccacgcacctatcgttaaaccaatcataatgatgataacgatagctggcagagaaatacgaatcccttgatatatcccttgttctatcgtatgccagcgatacccaaaacagcgagcaacgatagccgcgataattgtgctaatcagtaaaggaatatggggagatgattcaaattgaatgacagcaattcccattgataccatcatcacaatgataggtaaacaggcatagccaaatggaatgtgaatttgtggttcggttgtgtgtgacataacttcctcaaacaagcggtaagaaatacagagtaatttgcttttcggtagctttcactaataggaaattttcatcgaagcgatgagagattaatttacaaggggaaattcgacagagaggggagttgtggatttattcgggagctattctaacatatttgattaatatttcattatataaaataaaaaatacctgtatctcgttttagatacaggtattttttacatctcaacttaacgcttatttacgttgagttaccacttgaatgaacggagtttgtccttttttcatctgttcattcgcttgtttaaccatctcttctacattggtatgtaaatgagcggtaactttggtgtttgcttttttctctggaaccaagcgtgctttcactgtcttaccgtttacaacaaggttattttgttttgcattcacattaactggtgtgtttgtcgtttcacgtttaatgtctgcgtttaacttcacatcagctttcacacctgcaatagaaccgttattccagtcttgagctagattgttgttccatttttgttctgggtaaggagtatatttaccgctgccacttgctaaaaccgcacgacataaccgcaaccccaaaagcgagataatttcttattctcgctttttcatttaatgaaataatattacacttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaccccagccgtccacacctccccagtctaaatacaccgcactcagttgtttttactcaaactaaacttgcyatgcagggctaacagagtaatcctgtcgtcacttaagcaaaacaggagagcctaaaatgacaaccttcaaaatgagaactgagcaagaaatgatgttagagttagccttagttgcagtaagagaagaacaacrytttaccattgayggwtcrcaatacaccttaccaaacggacggggacaaacctttgtgtataaycttgcattcttagatattcgttttattgaagatggtcgcaaagatagcgttgtacaatttacctcaacscttrccccatcagcaccgccrttttattgtttattatctgaattagattaaatttaaacgccctttaaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaaaatattagcctgcttttgagataatattaaagaatattctcaaacttcgctaacatctctttcggccatacgcttgattgcacttcaccgatatgttttttacgcaataagaacattgccatacgagattgaccgataccgccaccgattgaaagtggtaaacgtcctgctaataaatctttgtgccagtccatttctaaacggtcttcgtcgcctgttaatgccacttgtaagcgtagtgcggtttcatcaacacggatacccattgatgataattcaaatgccgtaccaagttgttcgttccaaactaagatgtcgccgtttaagcctttatattcgccttccgataccgttgtccagtcgtcgtagtctggagcacgtccgtcgtgcgctttgccgtctgataatttgccaccgatgccgattaggaataccgctccgtattctttacaaatcgcattttcacgctctttgctggttaatgttgggtagcgtttcactaaatcttcgctgtgaacaaaggtaatctcttttggtaatacagatggaatatcaaaacgtgcttcaacggctaattcggttaaacgaattgcacggtagattgagcgaacagtctgttttaggtagtcgaagttgcgttttcctgctggaatcactttttcccagtcccattgatccacataaacagagtgtgttggatcgagtgagtcttcatctgggcgtaacgctttcatatggacgaataagccttcgccttcttggaaaccaaaacgtgcaagggtgtggcgtttccatttagcgagtgagtgaactacttcataaactgcacctgggatacattttacgttcacttgtaccgctttttcgatacctgataagttatcctgcataccgttgcctacttcacttaaaattgggccttgtacttcaataatatctaactgttcgatgaggttttgggtaaaggtgttcttaacaaagctgatttcttgttgttgaagaataaatgatttttgcataataaatttccttttgaataaattctgtaagagatgtgcgtaatttaaattaattcttgataaacgcaataacttacataaaaaaatcaaacaaagttaatctatattagatattatttaataatttatgctatattttagttaatttctaacaaaagatagaaaaggaacagaaaatgcataaaaactatcaggcaacatcgcagattgacttactggatcaacaaattctgcaagttttaacccaagatgctcgagttccctatgctgaaatggcaaaaaattttggggtgagtgcagggacaattcacgttcgtgttgaaaaaatgcgtcaagcaggaattattgaaggcactaaagtacgcattaatccgcgtaaactgggctatgatgtctgctgttttattgggattattctaaaaagtgcgaaggattatgaaaaggtgattgcaaagttgcaggagtttgatgaagtggttgaagcctattacaccacgggggattactctatttttattaaagtaatgacccataccattcaagaattgcactatgttttagctactaaaattcagggtattgatgaaattcaatcaacagacaccctaatttcaatgcaaaatccaattttgcgagaaattaaacctcaagcaaacgtttccagttgatcttgttcacatttttgaacattggtttgcaaaaaagatcgcaattctgaccgcttgattggtagaatgaagcggttaggttactcgaatttttctcaaaaggagtcaattatgtcagaagtgtttcatcttggcttaaccaaagcaatgttaaaaggagcgaaagtcgctattgttccaggcgatccagctcgtagtgagcgtatcgcagcaaaaatggataacccagagttcttagcttcaacccgtgaatttacatcgtggttgggttatgtgggcggtcagccaatcgtggtttgctcaacaggtattggcgggccatcggtttctatctgtgttgaagagcttgctcaattaggcgtgcgtactttcttgcgtattggtacaacaggggcaatccaaccgcatattaatgtaggtgatgtgttggtaacgacaggtgcagtacgtttagacggggcaagtcgccattttgcaccattagaatatccagcggtggctgatttccgttgtacgaatgagctttatgcggcagcgaaaaatcaaggtattgatccttatgttggtattacggcgtcatctgatactttctacccaggtcaagagcgttacgatacattcacaggtaaaatctaccgtcatttccaaggttcattgaaacagtggcaagaattaaatgtgatgaactttgaaatggagtctgcgacactcttcactatgtgttctgcattaggcttacgttcaggaatggttgcaggtgtaatcgtaaaccgtactcaacaagagatcccaaacgaagcaaccattaaaggcactgaagatcgtgcggtttccgtggtggtagaagcagcaggtaagttggctcaagattataaataaaatgttgatgaggcagtgtgaatatctcagactgcctcagtttttataagggattcgggttagtctatctcttttcttgtttttatatcaataaaccattgatcttttcccaagttttagctttaatgcttgcccaattttgatttttctaaataaaagtgtaaatagaggcaattatggcagaaagttttagcgtaacacgtcgttttttcgacgataaaaattatcctcgtggtttctctcgtcacggtgattacaccattcgtgaatcgcaaaccctagagcaatttggtcaagcctgcttagcattagaaaacggtgaacgtgaacctgctacagcggaagaaaaacagttcgtagccgttgttaaaggtgaaaaagttgcagaaactttcttagaaaaaacgtggcttaaataccgtgatttaaccagcaaaaccaaacgcatttacaccctttcaggcgatgtaagtggcgatcttggtggcgatgattcagcagaataatatgtgggaaggcttgaaaaagccttttctttttctttcttgataaattcaaatgaccttaccaattcatcaatatccagcgttacttgcaaaaaaggcagagaatctcaccgctctacttgcaccttttaatgcacctgaacttgacgtttttgcctctgacacaagccattttcgcttgcgtgcagaatttcgtgtttggcatgataatggtgatctctatcacattatgttcgatcaggcgactaagcaacgctaccgtgtcgatcaatttccgattgcaagccaactgattaatcgaatgatgacggtgttgctggctgaaatcaaagacaatgagctacttacacgtaagctgtttcagattgactatttaagtacattaagtgggcaaatcgccgtttcaatgctttatcataaatcgctgacagaagaatggatagagcaagcgaagttacttaaacaacggttgatcggctatggctttgatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgatcggctatggctttgatgtccagttaatcgggcgtgcgacgaagcaaaaaattgcattagattgtgattatgtagaagaagccttgaatgttgatgggcaaatttaccgctatcgccaagtagaaaacagctttacgcagcccaatggcaaaatgaacatcaaaatgttggaatgggcgagagcttgtacggcaaatagtaagggtgatttattagaactctattgtggcaatggtaatttttcaattgcgttagcaaatcaatttcgtaaggtattagcgactgaaatttcaaaatcatcggtagaatctgcccaatataatattgcagtaaacggcgtagataacttgcaaattatccgaatgtctgcggaagaatttacggaagcgatgaatggcgttcgggtcttttaccgcttacgtggtattgatttgaaacaatatgattgcaataccatttttgttgatccgccacgagtagggcttgatcaagccacattagaaatggtgcagggctatgaaagaatcctctatatctcttgcaatccacatacgttagccgacaatttaaaacaattaactcaaactcaccgcattgaacgctgtgcattgttcgaccaattcccttacaccgagcatattgaaagtggggtttggttaattcgtaacaaccaagtaggcgaaaaatagaacatttgacggttttgcatcattttgtgcttgacctagttcagagttatctatactattttacctgttttcagcggaggaatggcagagcggttgaatgcaccggtcttgaaaaccggcgagggttaacgccctccgtgagttcgaatctcacttcctccgccactgaatatacaacctgttggtaagtaattaccagcaggttttctctctcaagagcaaatcaaaatnnaaaatagctttcaactcggaggaatggcagagcggttgaatgcaccggtcttgaaaaccggcgagggttaatgccctccgtgagttcgaatctcacttcctccgccaactaaacatagaaaatatgaataatctaagctgaacgggattttcttagtttttagttacaatttattctcgctgtagatctcaaataatctttgggtaattatgttcatgagtcggtctacatcaggactattatcattattttcaagagtccttgctctaaatcagatatccaatattattaaataggtttgacttctattgagttctattttagaatgagttagtcctttcgtctgtgaaaggcttttttattgttttaatcttaactggagctttattaatggcaactatcaaccagctagtacgcaaaccgcgtgtgaaaaaggttgtaaaaagcaacgttcctgcattagaggcttgcccgcagaaacgtggtgtgtgtactcgtgtatacactacaactcctaaaaaaccaaactcagcgttacgtaaagtatgtcgtatccgcttaacaaacggttttgaagtaacttcttatatcggtggtgaaggtcacaaccttcaagagcacagtgttgtgttaatccgtggtggtcgtgttaaagacttaccgggtgtgcgttatcacactgtacgtggtgcacttgactgtgcaggcgttaaagaccgtaaacaaggtcgttctaaatacggcgttaaacgtcctaagtcttaatggttctccgttaagtaaggccaaacgtctaattagtcaaactatttaaaccataaactccagtcaatgcgactttgtcgccatagagttttggataatcctgaagatttataatacggagaaattgcaatgccacgtcgtcgtagtattgaacctcgcaagattcttccagatccgaagttcggttcagaattacttgcaaaattcatcaacgttttaatggttgatggtaaaaaatctatcgcagaatcaatcgtttataatgcgttagaaacattagctcaacgctctggtaaagatgcgttagaagcattcgaaatcgcacttgaaaatgtgcgtccaacagttgaggttaaatctcgtcgtgttggtggttctacttaccaagtaccagtagaagttcgtccaactcgtcgtaatgcattagcaatgcgttggattgttgaagctgcgcgtaaacgtggcgataaatcaatggcaatgcgtttagctaacgaactttcagatgcagcagacaacaaaggctcagcagtgaaaaaacgtgaagatgttcaccgtatggctgaagctaacaaagcgtttgctcactatcgttggtaataagcttttgatgtttgtaggcttcatctcaaaatttgtgatgaagcctattactatataaacaaattcacattagattccaaataaggtaataataatggctcgtacaactcccattgagcgctatcgtaatatcggtatcagtgctcacatcgacgcaggtaaaacaactacctctgagcgtatccttttctatacaggtgtaagtcacaaaatcggtgaagtacacgatggtgcagcgacgatggactggatggaacaagaacaagagcgtggtattacaatcacctcagctgcaacaacagcgttctggtctggtatgtctcaacaatatccacaacaccgtatcaacgtcatcgatactccgggacacgttgacttcacaatcgaagttgaacgttcaatgcgtgttcttgacggtgcggtaatggtttactgtgcggttggtggtgttcaaccacaatctgaaactgtatggcgtcaagctaacaaatataaagttccacgtattgcgttcgtaaacaaaatggaccgtactggtgcaaacttcctacgtgttgttgagcaaatcaaaactcgtttaggtggtaactctgttccgcttcaacttccaatcggtgctgaagaaaacttcaaaggcgtagttgaccttatcaaaatgaaagcgatcaactggaatgaagctgaccaaggtatgacgttcacttatgaagatgttccagcagaaatgcttgctgagtgtgaagaatggcgtaacaaccttgtagaagcagcagcagaagcttcagaagagttaatggaaaaattcttcgcaggtgaagaattaactgaagaagaaattaaatctgcattacgtcaacgcgtactttcaggtgaaataatcccagtttgctgtggttctgcattcaaaaacaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgttcaagcaatgcttgatgcggtaatcgactacttaccagcaccaacagacattccagcaatcgaaggtatcaatgaagatggtacaccaggcgagcgtcacgcaagcgatgatgagccattctcttcattagcattcaaaattgcaactgacccattcgtaggtaacttaaccttcttccgtgtgtactcaggtgtaattaactctggtgatacagtttataactctgtaaaacaaaaacgtgagcgtttcggtcgtatcgtacagatgcacgcaaacaaacgtgatgaaatcaaagaagttcgtgcaggcgacatcgctgcagcaatcggcttaaaagatgtgggtacaggtgatacattatgtgcgcaagaagcaccaatcattcttgagcgtatggaattcccagagccagtaatctctgttgcggtagaaccaaaaactaaagctgaccaagagaaaatgggcttagcattaggtcgtttagcacaagaagacccttcattccgtgttcacaccgatgaagagtcaggcgaaaccatcatttcaggtatgggtgagttacacttagacatcatcgttgaccgtatgaaacgtgagttcaaggtggaagcaaacatcggtaaaccacaagtatcttaccgtgaaactatccgtactcgtgttaatgatgttgaaggtaaacacgcaaaacaatcaggtggtcgtggtcaatatggtcacgttgttatcgacttatatccattagatccagaaggtccaggatatgagttcgtgaacgaaatcaaaggtggtgtaatccctggtgaatatatccctgcggttgataaaggtatccaagaacaacttaaatctggtccattagcgggctacccagtagtggatttaggtgtacgtttacacttcggttcataccacgatgttgactcatcagaattagcgttcaaattagcagcgtcattagcattcaaagcagcgtttgctaaagcaaacccagttctacttgagccaattatgaaagtggaagttgaaactccaccagattatgtgggtgacgttatcggtgacttaagccgtcgtcgtgctatggtaaacggtcaagaagcgaacgagtttgtcgttaaaatcaatgctgaagttccactttcagaaatgtttggttatgcaacagacttacgttcacaaactcaaggtcgtgcatcatactcaatggaaccgttaaaatatgctgaagctccaacaagtgttgcggcagcagttatcgaagcgcgtaaaaaataatttttaactttttaaaactccgtagcacatatcgtgctacgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcatcaacaaaggaaactttacaatggctaaagaacaatttaatcgtggcgataaagtccacgtaaacgtaggtacaatcggtcacgttgaccacggtaaaacaaccttaacagcagcaatcacaaccgttcttgcgaaaaaattcggtggtgctgcgcgtgcgtttgatcaaatcgacaacgcaccagaagagaaagcgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaccagaagagaaagcgcgtggtattaccatcaatacttcacacgttgagtacaacacagaatcacgtcactatgcacacgttgactgcccaggacacgcggactatgttaaaaatatgattactggtgcggcacaaatggacggcgcaatcttagtagttgcagcaacagatggtccaatgccacaaactcgtgagcacatcttattaggtcgccaagtaggtgttccatacatcatcgtattcttaaacaaatgcgatatggttgacgatgaagagttattagaattagttgagatggaagttcgtgaacttctttcacaatatgatttcccaggtgatgacacaccaatcgtacgtggttcagcgttacaagcgttaaacggcgtgccagagtgggaagagaaaattcttgaattagcaaaccacttagacaactacattccagagccagagcgtgcgattgataaaccattcttattaccaatcgaagacgtattctcaatttcaggtcgtggtacagtagtaacaggtcgtgttgagcgtggtatcattaaagcaggtgaagaggttgaaatcgttggtatcaaggatacaactaaaacaactgtaactggtgttgagatgttccgtaaattattagacgaaggtcgtgcgggtgagaacgtaggtgcattattacgcggtaccaaacgtgaagaaatcgaacgtggtcaagtattagctaaaccaggttctatcactccacacacagacttcgaatcagaagtttacgtattatcaaaagaagaaggtggtcgtcatactccattcttcaaaggctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcttcaaaggctatcgtccacagttctacttccgtacaactgacgtaacgggtactatcgaattaccagaaggtgttgagatggtaatgccaggcgacaacatcaaaatgacagtaagcttaattcacccaatcgcaatggacgaaggtttacgtttcgctatccgtgaaggtggccgtaccgttggtgcgggtgttgttgcgaaaatcatcaaataatctgtttttagtttaagaagattagattgttatcttaagggctggatgcgatatttaatcgtattcagcccttttatttggtgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattcaaaaaaagaattaaggtgactataataacttctgtcttacaatctcaaacagacaaaccccagtcgccacggatacattcagcgatgataccgatcctgccattggaatactcaccagttgatcacaatgttcacgggtaagacgacgcattccgtccccttctgcccccatcactaacgcaatcgagccagttaatttcacctgatacagactttctgtcgcttcgccagctgtgccgacgatccaaatattacgttcttgtaactcacgcatagtacgggcgaggttcgttactcgaataagtggcacggtttccgccgcaccacaagccactttgcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagttatggggatcggtcactccgtctaagatcaataaaaacggatttgctttgcgatctaaaatttggtcaagatcgctttcatttagctctttagcttgaatgactttggcaataatcccttgatgtacttcgccttgcactttgttatcgagtgcttgacgattgacctgttgaactcgaatacctaaacgttgtaattcgttgagtaatggggttaatcgtttatcttcacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttttagtacaaacacttcgattaatcgttcgggtgcaacatctaaaaaggatttaacggcgtgaataccgtagattcgttcgctcatatttattcttctattctgtatcttatttttcccctctctcgtttacgggagagggtggagaaaaatccgcaggattttcggagggagagggcaattaatgttctcttgttttaaagaactccacatccggataacgctcttgaaccaagttgagattaaccattgttggggcaatataggttaagttatcgccaccatcgagggctaaattctgctcgtttttacgtttaaattcttcaaacttcttggcatctttacattccacccaacgagcagttgctacattgacggtttcgtagattgcttccacgttatattcgattttcaggcgtgaaaccaccacatcaaactgaagcacaccgaccgcaccaacgattaagtcgttattcatcaatggacggaacacttgcacagcaccttcttccgacagttgcaccaagcctttaagcaactgtttctgcttaagcggatcttttaggcggatacggcggaacaattcaggggcgaagttcggaataccggtaaatttcaagttttcgccttgggtaaaggtatcgccgatttggatcgtaccgtgattgtgtaagccgataatatcgcctgcgtaggcttcttctgcgtgggagcgttcgcctgccataaaggttaaagcatcggagatgatcacatctttgccgatacgaacgtgcttgagcttcattcctttttcatatttgcccgatactacacgcataaaagcaacacggtctcggtgttttggatccatatttgcttgaattttgaacacaaagccactgaatttttcttcacttgcttctactttgcgtaaatcagcttcacgggcttgcggagcaggcgcccactcggttaagctatctaggaagtgatcaactccaaagttacctaacgccgtaccgaagaaaacaggggttaattcaccgtttaagaaagcgtccagttcaaattcgtggcttgccccttgcaccagttctaattcgtcacgcagttgctgagccaaatcatcgcctacggcttggtctagctctggattgtttagccctttgacaatacgcacttcctgaatggtatgcccttgccctgtttggtagagataggtttcgtctttatagagatgataaacgcctttgaacaacttaccgcaaccaatcggccaagtgatcggcacacagttgatcttcaacacgctctcaacttcgtctaacaattccatcggatcacgaatatcacggtcgagcttgttcataaaggttaaaatcggcgtatcacgcaagcgggttacttccatcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgatggtacgttcttcaaccccttttgcactgtcgattaccattaaacagctatccaccgccgttaaggtacgataggtatcttccgagaagtcttcgtgccctggtgtgtcgagtagattgactaagcaatcattgtaagggaactgcattacggaggtagtaatcgaaatcccacgttgcttttccatttccatccagtcggatttagcgtgcgcttgtgagcctttaccttttaccgaacctgcggtttgaatggcatttccgtaaagtaacactttttcggtgatggtcgttttaccagcgtcggggtgagaaataatcgcaaaagttctgcgtttatttacttcttgagggtaattatttaatgacattctattctcgttttctttttcaaaaatggtggctattttctctgatttagtcggagataacaaccgatggaggtgagttatattgagatttgcaaactattgacaaaaactgaccgctaataaaattttatttatcccgatcatctacgccaattagcaaatagttgccttgaatatctgctaaacttctaaaaccgatattaaaaatttcacaggccttattacgattaattagacgataatcaaaattatcgtggtgatgtccgtgaaaaatcttcttcacgcccatttttcgagccagttgattaatcactgcaaaaccttgtgggtgtgggcgaggagcttcgtgggtaattaaaatatctgctttttgcgtttctaaaccttccacatctgaaggaaaaattgaggtgcggtgacgcagtggtacaccacctcgccaaatacgctcttgtggactatattggcaataatggataggatcaaagaacattgggcggtgaggaggcatccagatatgccctctaaaaacgccccctagtcctgcaatttttgtgccttgtatattgacaacgcgaccgtgaagatttcgttctttccaagcagttccccaaatagcatcatacgcagcaaccgttttactgtcgtggttaccgtgaataaaccaaatatcgcagtgttgagccagcttatccaactctgcggtcgtggttaattgcaaatcccctaaaatcactaacgccacattctcacgttcttgaacaaaggggtaaaggtgggcgtagctaccgtgaggatcgcccgcaaaaagtatcattcgctcttctcgttttggtttttaaaagttaatgttatggattcttcatttaagatcgcttcaatcactgctttggtttgattataacgatctaaataacttggcgattcaatttcaatataaggtacgttatatttttctaacaattttttgagtaactgctggaagcgttggcgttgtttttgtgaacctaaactacgcagaccatcatcaacccatttagtgttatttgataataaaatagtgacatcaaaaggatattctttaatcatcgaatctaagaatgggtgaggtttgccttcatattgaatacagaatgcttgagtagtaatgtaatccgtatcaacgatcgccactttgtgtgcgtgcttcattgcataatcaacataacgcttatgccctaatgccatttgtggatagtctgaatactgcattgcctgttcatcaccgccaagttgttcaaagacaaattctcgcccgtattcccacgccgatgtcgtattaaatacattagcaagtttgctgactagaacagtttttccgctactttcaccacctaaaatagcgatagttttcacaaagaatggacgcacctcttttggaataaaacgccagtattggaacggattgttgcggatctttgtcgctgatacattaaatgagttacgttcaggatcgaccaaatgcacttccaaatttaagtatttctcgtaaggttctttatcttgaatctcactgctaaagactaatgttggctgaatatgtttttcagcaaatagctctttgacacgttccacccagccctcccagccgtttggatagctaggaataccatcttcaaccaaatgatgaatgaaaatctgtttttgctgatatttaaaaatctgttgcatccaacgcaaacgatcttcattcgttggcatacgtttcattttactatcacggaacagttgtaaatcacgttcagtatcagtacaaacaataacgtgtagcatatccaccttactaaaggcttcataaatcatattaatatgccccgtatgcactggatagaacttaccaaaaattacgcctactcgttgattttgttcctcaacgatattcaacactttatgcaacgcacctaattttgtcgcacttggatttttaattttccccgacactaattgattaaaataggctctagttacccctgcttgctcacaaacatcatttacttttagctttaactgtttacgtttttgttgaagataagcaaaatttgtcataagttcgtcctcacattgatagacagaatgataggcgaaatcgacctttttgtcatttaaaaatgtatagtcaagcggtaagatttacataacaaattgcaaaattatgtataaagactttctacttttgcactattcggtataatctcgcttccaaattattcctcatttaacaaattatggcgttattgattacccacaaatgtaccaactgcgatatgtgcgagcctgagtgtcctaatcaagcgatctcaatgggcgatgaaatttatgtcatcgatcccgatctttgcacggagtgtgttggacattacgaaacgccgacctgccaaaaagtgtgtccgatcaacaactgtatcatcaccgatcctgagcatattgaaactaatgaacagctttgggaacggtttgtattgattcatcattcggataaactatgataactttctgattcgttgagctaattcactaacctgctgccaatctgtatattcatactctctgctagtatctgtatcacctttcgttattttcataataaagcgaatcatggttttatcaaaaaaattatagcgaggatagagtaatgctccagcaaatacttcagcgatatttggtttccatagaattttgtctagcaatttacgtgtatatgtattcgtataaggtgtattacgagttattttacgagcagttaaattgacactaaaaaaaacagatttttttctatttagtagctcataatatcgatcaataaattgttccaatactgggtcaaaatgtccatatcgaatcgatgcgccaataacaatacaatcaaattgttctaatgtttctacagaccaaagagaaaagtctcgtaaggagaaaacttgtgtctcttgctgtagctccttcgcaagatagtcagaaattttttttgtttgtccatcatttgttaaataaaatattgcagttttcatattatgttccctataacctattgtgaaaacgatcttaacaatttaaatttaaaagaactataatttgttttatatcaatccgttaattaaagtattttgattttatttagaatgaaaattaaaattcatctgagtattagctcaattactgttcacttataaaaggagtatatataatgaaatctatttttttacgtacagctttgttagcgtatatgtttgttgcactttctgctcaagctgcccctaaagagccttatactcaagccggatttaacacacgtttagcagagcaacagcaagccccaattcattgggtttctattgagcaaattaaagagagcttaaaaggcaaagccccgatgaatgtgagctttgatattgatgataccgtattagcaagtagcggttgcttctactatggtaagcagaagtattcaccgaatgattatagctatctcaaaaatcaagagttctgggacgaaattaatgcaggctgtgataaatactctattccgaaacaagtagctcaagatctcattaatatgcaccaagagcgtggcgatcagattttctttatcacaggaagaactgcgggtaaggacgaccaagtcaccccgttacttgaaaaaacctttggcgtaaaaaatatgcaacctgttaattttatgggcggacacggtcaagataaattaaaaacaaaatacaataaagccgcagggattttaaaacataatattcagttacactacggcgatagcgatgatgatattctcgccgctaaagaggctggcattcgtggtattcgtgtattgcgtaccacaagttcaacttatacgccattccctcaggctggcggatatggagaggaagttattataaattcaagctactaataaatatccccgtcttaaaaggcggggatttgttattcccttatagcctttgaatactgttcaagtatagattgtacgaaataaattaacagaagaaggcatattgtctagatgagtgctatttttgttactccaattgtgcgatactgtttcgttagactaccccttccaaatataaaatgagaaaaactttctgaatttttaaaatgcaaacgtttgcgtgatccgttataatgccttcaattttgttttctatcattaacggaactgcccaatgactgtacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacctttcgtggctcacctgccttatctgactttcgtttaaaccaacttcaacaaaaattcgagcaacatcaactgcctgttaaatcggtctatgccgaatatttgcattttgttgagctaaaccgaccgcttgtagccgatgaaacacaaaaaatccaagagctgttgcattatggcccaacccttgcggaacacgaaccaaccggcttttgtttgattgtaacccctcgcattggtacgatctcttcgtggtcgtcaaaagcgacagatattgcccataactgtggtctagaagcggtaaaccgcattgagcgtggtttggcgtactattttgagtttgaacaagcgttaaatgaagcagagttggcaaccctaaaaggcttgttgcacgaccgtatgttagaaactgttttaaccgatgaaaaccaagcgaaccaactatttgcccagcacgagccgaaaccgtttacgactgtggatattttaaacggtggtcgcaaagccttagaagtggcaaacgtggaattaggtttggcgttggcagaagatgaaattgattatttggtggaaaatttcacggcattaaatcgcaatccgcacgacattgagctttatatgttcgcacaggcgaactcagagcattgtcgccataaaattttcaatgcagactggacgattgacggcgaaaaacaagagaaatcgctgttcaaaatgattaaaaacaccttcgagaaaacgccagattatgtgctttctgcctataaagataatgcggcggtaatggaaggttccaaagtcggtcgttggttccctgatcaagacgggcaatatcgctatcatcaagaagatacgcatattttaatgaaagtagaaacccacaaccacccgacagccatttcaccattcccaggggcggcgacaggttcaggtggcgaaatccgtgatgaaggggcgacagggcgtggtgcaaaaccaaaagcaggtttaaccggtttctccgtatctaacttggtgatcccaaactttgaacagccgtgggaaaatccgctttctaagccgaaccgtatcgcatctgcgttagatattatgattgaaggtccacttggcggagcggcatttaacaatgaatttggtcgccctgcattacttggttatttccgtacctatgaagaaaaagtaaacagttttggtggcgaagaagttcgtggctatcacaagccgattatgctcgcaggcggtattggtaacattcgtgccgaacacgttcagaaaggcgaaattcctgttggggcgaaattaattgtacttggtggccctgcaatgaatatcggtttaggcggtggtgcggcttcgtcaatggcgtcaggcaaatccaaagaagatttagattttgcttccgttcaacgtgaaaacccagaaatggaacgccgttgccaagaagtgatcgaccgttgctggcagttaggcgatgagaacccgattttatttattcacgatgtaggtgcaggcggtttatcgaacgcaatgccggagttagttcacgacggtgatcgtggcggtaaattcgatttacgcaaaattttgtgtgatgagaaaggaatgtcaccgcttgaaatctggtgtaacgagtcgcaagagcgttatgtattagcggttgcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattgccattatttgaagccctttgccaacgtgagcgcgcaccttatgctgtgattggcgaagcgaccgaagagaaacatttaaccctacacgacgatcattttgacaacaacccgattgatttaccgatgaacgtgctactcggaaaaaccccgaaaatgcaccgtcaggtttcgtcaaaaaccgtccaaaatccaccgcttgcacaggaagatattcagcttaaagaagccttccaccgtgtgttacgcttgcctgtggtggcggaaaaaaccttcttaattaccatcggcgaccgctcggtcacggcaatggtagctcgcgatcagatggtcggcccgtggcaaatccctgttgccgactgtgctgtaaccacagcaagtttagacagttatcacggcgaagcaatggcaatgggcgaacgtgcaccggttgccttacttgacttcggcgcatctgctcgcttagcggtagcggaaagcattaccaacattgcggcaaccaatatcggcgatattaaacgcattaaactctcggcaaactggatgtcggcggcaggtcacgcaggcgaagacgcaggattatatgaagcagtaaaagcggtgggcgaagagctttgccctgcacttggcattactattccggtaggcaaggactcaatgtcaatgcgtaccacttgggaagagaatggtgagcaaaaagcggttaccgctccactttctctcgtcatttcagctttcgcgcgtgtggaagatgtgcgtaaaaccgttactccacaacttcgtaccgataaaggtgcaacacgcttattgttactcgatttaggcgaaggcaaaaaccgcttaggtgcaacggcgttagcacaggtttacaaacaacttggcgataaacctgccgatgtggtgaatgtggaaaccttgaaaaacttcttcaacgcaatgcaaaccctagttgcagacgataaattactcgcttaccacgaccgctcagacggtggtttaatcaccacccttgcggaaatggcgtttnnnnnnnttaggcgacaatggtttagccgtgttattcaacgaagaactcggtgcggttattcaaatcaaagagggcgacttaaatgcggtgcgtgatgtattgaaagcccataacttgctacacattaccaaagacatcggctcggcaacggaaggcgatctgtttgaaatcaccagtggcacacgcaaattactcagtgaaaaacgctctgaattgcgtggaatttgggcggaacttacacaccaaatgcaacgcttgcgtgacaaccctgaatgtgccgatcaagaatttgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatgtgccgatcaagaatttgcaaccaaaaaagacccaaataacaaaggcttatctgcattcttaacctatgatgtcaatgaagatattgccgcaccgtttatcaaccgtggcgtgaaaccnnnnnnnnnnatcttacgtgaacagggcgtaaacagccattacgaaatggcagccgccttcgaccgtgcaggcttcaatgcgattgatgtgcatatgagcgacttaatggctggcagacgcaatctnnnnnnnnnnnnnnnnnnnnnnnnnnnnnnnggcttctcttacggagacgtacttggtgcaggtggcggctgggcgaaatcgatcctattcaacccaatgttgcgtgatcaattcagccaattctttactaacccgaacacnnnnnnnnnnnnnnnntgtaacggttgccaaatggtgtcaaacttggcggaaattatccctggtacagaaaactggccacgcttcgtgcgtaacaaatccgaacgctttgaagcccgtgtgggactggtgaaaatcaacgaaaccaactcactctggttcagcggaatggcaggatcgcatatgccgattgccgtttcccacggcgaaggacaggtggaattcaannnnnnnnnnnnnnnnnnnnnnnnnnnnnnnnnnnnnnnnnnnnnnnnncaatacatcgacaataatcttcaaccaaccgaagtttacccagccaacccgaacggctcggtaaacggcattaccgccatttctaacctagacggacgtgtcgctattatgatgccacacccagaacgcgtttaccgtgcggtgagcaactcttggtatccggagtactggagggaagatggggcgtggatgaggttgtttagaaatgcgcgtgtggcattcaaataatctaattcttacgagttctatttagaaattttagattgttaattacaatgtaggagcttaatatgaaaaaattattagcgagtatttcttttattatttttatagtcggctgtacacctaaaccatcatataatcagctagctatgcaattacaaatggatatgtctaaacaagatgtgattagcttattagggcaaccaaataaagtatctgctagaaatacagataaagggcacgttgaagtgctaagctattgggggaaaacacttgtcggatttagtatgatagataatcagatgttatctcaagatagattatcagtaaccttattaaataataaagttacagaatggggagataaacttgatccagccgaaatgctggaaaaatcacaagaaatgacgagagagtcactggaaaagattcaaagtaatatcacaaacaaaaagtaatatccctttctccgatagctcctgtttttgacaagatctatcaaagtatagtagataaaatgattgctgatgaatattcttacaagcctttctattaaaaggtataatagacaaatctactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcattagtaaccactttgtcatataggcatagttttcacgaaattagcaaccattttgtctactatgccccctaaaattaagtaccgaatttatctaaacgactacatctaactcagattttagtttagaagcaatagcccttaataaatgattaagcattgtgtatctttttctatacattgagcgtttattactcggaatatcttcaaggttttttgactctaatgttaagggaagttcccaatattcctttaattcaccattactctctttaaaaatagtatcataatcaacaaaatagcgtgtgctttgaacaaagcgtgacttattctgatatttttgtggaatgccaaataatttagaataccctaagacctgagttaaagctttcatggcttcaaccattaaataggctggacgaagcccatggcattttttagttagttgtttgactaattctttagaaccttcaaagttcggaccttgaataactgcgataagtaatgcattttctaatttaccaaatgtcaataaataaactaactgaccgcttggtttatagcgtaattctaatgcccagaaaccctccattggttgatattcgttgacatttaaatagatttcaaaatcttcaattacttctgtaaaacatatagggctatcccataactgagggagatttttagataagagtactttaggtaaaaagtctaaattgtcacaaatcatgttaaaacgtctttgactattaaagcgtttatctaagaaacgatgaactaaaggatagctataatctgctcttttgattaataacggttttaacgaagattcagaattaattttatgttcaaatttccttatgagagatctatgtaatatagagcgaaaacgataacggaaacgttttaatctataagatttttttcctctatctggatagagatgagacggctcaggccatttataaactgtattgtgcataatgaaatgtgttttcgtgactaatagagccgttggagaatatcacctccaacggacagttattactatattacaacgcctcaatcgccttatactgcgtctgcaatttctcaagtccgtcttggtactcttgcattttttcacgctctttggcaataaccgcttctggggcttttgcgacaaaggcttcgttgctgagtttaccttcgatacgtttcacttcgccttgaagtttttcgatctctttggtcaaacgagcaagctcggcatctttgttaataaagccagccattggcactagtacttctgcgttgccaactaatttcgccacagaaagcggtgcttcttcgccttgggcaagcacttgtacgctgtctaatttcgccattgcttttaacaagcggtcgttttccgctaacattttgcaatgttcgtcagataggttacgcactaagaaatccaagcctttgcttggggcgatgttgcactctgcacgaatattacgcactgccacaatcaactctttcaaccagttgatttgcatttctgctgcttcgtcaatttggctttcttctactttcgggaaaggttgtaacataatggtgtcgccttccacccctgcaaagcctttcactttctgccagatttcttccgtaatgaatggaataatcgggtgcgctaaacgtaataatttttccaacacacgcacgagggtttggcttgcacctcgtttttgagcatctgtaccgttagcaaacacaggtttggtgagttctaagtaccagtcgcagaattggttccaagtgaactcataaatggtatttgccgctaaatcgaaacggtattggcttaacgcatcacggaactcgcctacggtgcggttgaaggtggattggatccaacgatccgccaagctgtattccacttcgcctgccgataagtctaatttatcgttagtgagtacgaaacggctcgcattccataatttgttacagaaattacgatagccttccaaacgtttcatatcccagttgatgtcacgcccgttgctcgctaatgccgctaaggtgaaacgcagtgcgtccgtaccgtgcggagcgataccgttctcgaattctttacgggtcgctttggcaattttttccgccaactgcggttgcatcatattgcccgtacgtttttcaagtagatcttcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgataccgtcaatcatatcaatcgggtctaatacgttcccttttgatttcgacattttttgcccttgttcatcacggatcaagcccgttacatacacagttttgaacggcacttgcggtttgccgttttcatctttgatgaagtgcatcgtaaacataatcatacgagccacccagaagaagatgatgtcaaagcctgtgattaacacatcggtcgggtgatacattttgagttctttcgtttgctccggccagcccaaggttgagaatgtccataagcctgatgagaaccaagtatctaacacgtcttcatcttgttttaacgcaacatcagcatttaactgatattttgaccgcacttccgcttcatcacgagccacataaacattgccttccgcatcgtaccacgcaggaatgcggtgtccccaccataattggcgagaaatacaccagtcttgaatatcacgcatccaagagaaataaaggttttcatactgtttcggcacgaattggatttcgccgtcttccaccgctttggttgccacttcggcaagcggtttcacgctcacataccattggtctgtcagcatcggctcaatcggcacacccccacggtcgccgtaaggcacttttaagtcgtgcggtttgatttcgtctaataaaccgagtgcttcaaagtctgccacgattttcttgcgtgccgcaaaacgctctaaaccttgataatccgctggaataagtgcggtgtaatttgtcaaaggtttaccgtctgagccgataatttccgcttccgcacgaatgtccgcatttaaggtcatcacgttcaccattggcaactgatgacgcttaccgacttcgtagtcgttgaagtcgtgagcaggagtaattttcaccacgcctgtaccgaactcacgatctacataatcgtccgcaataatcggaatttcacggtttgcaagcggtaggattacggttttaccgatcaaagactggtaacgttcatcttcagggtgaaccgccaccgccgtatcgcctaacatcgtttcaggacgagtggtcgctaccaccaaataatctttaccgtccgccgttttcgccccattggctaatggatagcggaaatgccacagcgagcctttgctctctttattttccacttcaagatcggaaatcgctgtatgtaattttggatcccagtttaccaagcgtttaccacgataaatcaaaccttcttcgtgtaaacgcacgaacacttcttttaccgcattagacaagccttcgtccatcgtaaaacgctcacgatcccagtcgattgagttaccaagtcgtctcatttgctggctgattgtgccgcccgaataagctttccaatcccagattttattgataaaggcttcacgcccataatcgtgacgggttttgccttcttccgccgcaattttgcgttccaccaccatttgggttgcaatccctgcgtggtcagtacccgcttgccatagggtgttattgccttccatacggttaaaacggattaaggtatccattaaggtttgctggaaagcgtgccccatatgcaaactccccgtcacatttggcggtggaattgcgatacagtaacttggtgcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttattttgtataccccaatattaacaactcgttcactaaatcctcacaccattgaggcaatttatctgctaatttagtaacagttttatttgctgaaataacaagctgtattttgggactatctgatgaattatcgtaaataaatgtttcatcatttaataaaattgcttgaattaaattttctcgactaatttgataacgtcttttaatcgtctcttcatcaataaaatgcccgcctgcttttactcttgctttgacacgagcaatatttatttttggatcatctactccaacataatttaaacgagtataaaaatttttcttcgctacttccattctttgcaaaatagatttacccgatagggttgattccattgaaaaagaaatattatgtcgtattgcaaatttaaatagctctattgcttttctacctgcctcaatatctgccaatcttggattgtcaggattaatttgcattgcaatatgatctgaatcaatcacaatttgcacggaatcccgattaaaagagcgtaatgtagatttacctgctccatttgttccgcagtagaaaatagcaagagacttattgtgcatattcaatcactcgaataaaaccatttgggtgatgctcaatcaaatccccatttcctcgacgataggtcaaaacttctttctttttcttttccgctatccaagcagagaataaaacatcaagctctttttgtttttgtagaatttcgtctttcgtcattgttattctcctagcaaggcggtcaatttcatcatattactcacccttcaccatatccaaatgcggtatcccatcttccaaataaacctcagaaatcggtttaaacccaagcgattgataaaaatcttgcaagtaggcttgggcttgcacatagacgttttcactttgccattgttgctggcaaatggttaaggcttgtgccatcaattttttcgcaaatcctgttcctcgtgcttcttcggtaaccaacactctgccgatatgcacaccatcttgttcggggataatccgacagtaagcggtcagttttgccgaattttttgcaaaaaggtgcaaggctttccgatctttttcatcaacttcttgatacgcacaattttgttctacgacaaaaacagcgactcgagcttggtaaatttcaaacagttcttgggcagaaagttcggaaaatgcctttagttgccacatacgccttgcttcaatcctaagattactaaatcttcaaaatctgtttccatatctgcaacttggggaagttttccccaaatttcaaagcccattttattcagtaagcctaaactttgatcgttattgccgaacacaaaagctaataatgtatgcagttggtaattgggcatttgtttaattaagaaattcacacaggctttaccgatacctttgccatgaacagctttatcaagataaaaactgatttcgcgagagccgtcataagcagctcggctataaaattgcgagtagctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgactgataacttaccatttgatattgccaaccttggtcagaatagagtattggcgttgctccgtcaagccttgccacagcttgttttatcattcggcttatctgctcgaaacttgggtttcttgccacatcataagcaataatttcaccgttaaacaagtccttaatcggcgagagataaagtttaccttctgcacacttaaattcactcacatcggtgacccatttttgatttgggactgtagtgtgaaaattctgttttagcaaattctctgcaattttgtcgacttcgccacgataagaatgatattttttgcgtttgtttttccctttcaaaccaagttgttgcagtaagcgttggacttttttatggttaatcagccatatttttcttaattccagcgtaatacgatgataaccgtaattaccgtcatttttgtgataaattttgatgacttcttgcttaatcgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttatctttatgataaatagtcattttttctaaatgttatttctatttcatttcaaataaggatattctcatgcaaaaaatactttttattattcattcttctccatatggtgatgaacattttttcagcgcattacgtttagctttacaactacaagagcaacacaaaagtgcggttgaattaaagttattgctaatgtcagatgccgttagcgggggacttgctcatcaacagctggcagaaggttaccatttgcaacaaatgcttgaaattcttaccgcacaaggggctatggtcaaattatgtaaaacttgcactaatgcacgtggaattacctcattaccaccagctgaaggcgttgaaattggtacattagttgaattagctgattggacggtcaatgcagataaagtgttgaatttctagttgttatcctattcttaatgttaggaataaaaggcataacagacagtaggatgacagggcgaaagaagtatttcgccctttttattttatatttcctatttatgagagatgtgttgccctcttcatgttttgtacgaattgtgccaattcaagcaaacattgagggtgattgtcgaggtttcgttcaataatctgaactgtagcggaacccgagattgcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggaacccgagattgcaccggcagcccctaaacgcagcgcctctttaacttgttccggttttgcgataccaaaaccttgtaaaattggggcgctttgatattgggttaacccttcaataagaacatctaaattggcagcttgtgtttgattttctgcgctagtaacgccggctcttgagactaaataagtataacctcgagtatgttgagctaccgctttaattgtggattcattagcattaggtggacaaatgaaaaccggctgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcatgacgttgagcagcttggatatattcttctgcggcgagtaaaggaatatctgcaaccaatacggcatcaacgcccacttcggcacagcgtgcatagaatttatcaagagtttgcgcataaattaaattggcacaaagcaacagactaatcggtatgtccggataggttgaccgcactttggcaagtaactgaaaactttcttcggtgctacaacctgcattgagagcccgattattggcagcctgaataactggtccgtccaacaagggatcagaaaagggaaagcctaattctaaggcatccgcgccattatcaactaaagtacaaataatctcaaaagagcgctcaaaatcagggtcacaaagtgtcacaaaaggaacaaatcccccttgttttttatcagctaattgagcaaataaacggctgaaacgagatgattgcacaatcatttgatagctccttttgcagttaaaattttatccaccgtgaaaatatccttatcaccacgaccggatagattcacaacaagtagttgtgtttttgttggatcttgcttgatgagttttaatgcgtaagccaaagcatgggagctttctaaagcaggaataataccttcatgttgtgctaaagcttgaaatgcctcaagtgcttcatcatctgtaatgctctcataatctgcacgaccaatagcatggagatgcgcgtgctgcgggccgacagaagggaagtctaaaccggctgaaatactataagactcttcaatttgcccgtctttggtttgcataatcggggatctcatcccaaaataaataccgactgaaccatgacgtaaaggcgcaccatgctcaccggtttcaatgcctttgcctgctggttcaatcccaattaggcgtacacttttttcttcaataaaatcggcaaacataccaatggcatttgatccgccgccgacagccgcaataaccgcatcaggtaagtgcccttccttctccaaaatttgccttttggtttcttctccaatcattttttgaaattcacgcacgatggttggaaatgggtgcgggcctgcggcggtaccgagcagataatgtgttgtggcataatttgcagcccaatcccgcatagcctcacagcaagcatctttgagtgaacaagagcctttttgtacagggatcacttcggcgcccattaacttcattcggaaaacattaggcgattgacgttcaacatcttttgcgcccatataaatacgacaaggtatattgagcattgcacaggctaatgcagtcgcaacgccatgttgtcctgcaccggtttcagcaataatacgtgttttccccatgcgttttgctaagagaatttgccctaaaacttggttggttttatgggcgccaccatgcaataaatcctcacgttttaaataaagtgtagtgttcgtgccttttgttaaattacggcaacatgttaatgctgtagggcgaccagcgtaattttttaataaatcctgaaattcttgttggaaagcaggatcttctttcgcctccacaaaggctttttccagttcttgtaaaacaggtactaagatttcgggaacgaacataccgccgaactcaccgaaatagggattaagaatggttgtcatagcatttccttttacatttttacgataattttttaggtgtttgacgctccaaaattttgttaaacaccgctgctaatttttgtgggcttttcatgcccgttagactttctacgccggaattgagatcaagacctaagcaatgttgtgataaggcaagctcaatattgtccggattaatgccaccggcaaggagcagtttagatttatattcttgagggattttcgaccaatcaaaaggctgtccagtccctccacattgattgccgattttgctgtccaatatgtagcgatccacatggggaatcgacggaatttttaccgcacttttactttgtgttttggttgcaagggcggctaatgtaattttagggggcgcatcaactgaaattgctttccaaatttggcatgattgcggtaattgttggcgaagtgcggcaataaattcagccgtttcttcgccatgtaattgtactgcaaataaatcaagttggttgacgattttttcaataaaatcaataggttgattttgaaatacgccgacaaaacgcaagggagcctgtaccaccaactcttgagcttggcgtaatgaaagctgtcggggagaatgttctgcaaaaattaagcctccatacaatgcgccttgctcatacacggcttgtacatcctgcggacgagtaagtccacaaactttattttcgccaaaaattaaggtgcggacgctttgatggagatcgggacttcccatcaaactgctaccaataagaaaaccatgtacatcagatttcagctgttgaatttgatgatggtggtaaatacctgattcgctaataataattcggtctgccggaatttggcgtgcaagaggcagtgtacgagcaatatcgacagataaatcatgcaaatcacgattattgataccaataactttagcgccaagctcaatggctcgagttaattctgtttgatttgaagtttccgttaatattcccatgcctaatccatgtgcaatttctgccaatcgacgataggtttcatcatctaacacagaaagcattaataaaatcgcatctgcttgataatagcgcgccaaataaatttgatattcgctcacaataaaatctttgcacaaaattggttggttgacgagctggcgaacgcgcggaatataagtaaaatccccttgaaaatatttttcatctgtaagaacagaaattgcggaggcataacttttatacacctgtgcaatatcttctacattaaaattggctcgaatcaaaccttttgagggagaggcttttttacattcaagaatataagccggtttttgcgccgaaccttgctgaagtgcggtataaaaatcccgatcactaggttgaaggctatgttgaaacgcattcaaaggaaaatgggtttgttggtgttgaatccaaagtaatttatcctgtacgattgttttcaaaatactaggttgcgtgtggcgttgtggcatagtgaattccttttaataacgcgttaattgagataaaacattaacacttttaccagattggatgacatccaaaacctgttgtgcgttatgcttgatattctcataaccaaacaatttcatcaataatgccgtattcattgcaacggcttgggcatgttcaggtttgccttgaccttgtaacagtgcggttatcatttgggcattttctgcaggttcaccaccacgtaaagattccaatggtttggcttgaaaaccaaaatccaaaggagaaaggctgtagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaggctgtagtaggtgattttcccatcatagatttccgctacatcagtccgtccatgaatagccacttcatccaatccacagccatgcacaacaaaagtatgtcgatgaccgagttgtgcaacggtttcggcataaggtttgagtaaatgaggagaataaacaccaagtagttgacgttttggtcgtgcagggttgataagcggccctagaatattgaagatagtccttgtttttagtgcttgacgcacagaaaccgcgtgtttaaacccgaggtggtattgctgggcaaaaagaaaacaaagcccgatttcatccaatgcccgtcttgcaatatccgctggcatattgatattgaccccaagtgcggttaataaatcgcttgagccggttttgcttgatacacttcgatttccatgttttgcgatttttaacccacaagcagctccaactattgcagaggcggtagaaatattaatggtattggcactatccccaccggtgccgacaatatcggcaaatgcataatcaggggtagggaagggttgtgccgcattaaggcatgctgccactgcaccacttatttcttcagcgctttccccgcgtatttttagcgtaattaacagcgcagtgagctgtattggatttaattccccttgaatgatggatgtgaaaagctgttgcatttccgaggatgttaaatgagtttgctcaataattttaagtaagagttgttctgtttgcatattatattccttgtgttctattaaaattcattaaatatgcgatagtttgtttcaataattgagatccctgtacagtcaaaatactctccggatggaattgaaaaccacaaatcggtaaagatttatggcgaattgccatgacgatattttcataagtggcattaacaattaactcatcaggcaactcaacgcccattaatgaatgatagcgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaacatagctaaattatcatgagaaattagcgataccttgccatgtaacacttcgccggcatgaacaattttgccaccaaaagattcaatcaaagcttgatgccccaagcaaataccaatcataggcactttgccttttaagcgcgcaattaatggcagtaaattgccggcttcagagggattacccggaccaggggataaggcaagtagggtattggggtgagctaaggtggcttgttctaacaacgctatatcacaatcgttacggtaaacttgaacctgatgacccaatgtccgaaattgatcgactaagttgtaggtaaaggaatcaaaattatctaaaaaaataatggttgccataataaaaatccttatattgcactgtgagtctgaataatggcattaatcactgctttagctttatggcgggtttcatctgcctccatttgtggatcagaatctaacacttctccacaaccggcttgaatatgcgctatcccgttttgtacaaaagcagaacgaatcacgatacaggtatccaaattaccgtttgaggacaaataacccactgcgccaccataactatgtcgtttttgttgctcaacaaggtaaattaattgcatcgctttaatttttggcgcaccggttaaagttcccatattcatacaggcttgataagcatgcaacgcatccagttcagggcgcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatccagttcagggcgcaattttcctacgacccgagaaaccaaatgcataatgtgcgaataacgatcgatttgcattaatgccttaacatggcgtgagccactttcacacacacgcgccacatcattacgagccaaatccaccaacattaaatgctccgcgagttctttcttatctaagcgtagctctaattctaagcgagcatccagatccagatcgatttgaccttgctcatcaaaacctcgcggtcttgaaccagcaatcggataaatttccacttggcgtgtttgtgcggaatatttcaaggcgctttccggtgaggctccaaataaagtaaacacctcatcttgcataaagaacatataagggcttggattggtttgttttagttgtcggtatgcccgaagaggatttggacaagctaaagaaaaacgtcttgatggtacaatttggaatacatccccaatatgaatatgatgtttaagtgaacggataatatctttaaatgcctcatcttctaaattcgtgcgaacttctgtggaggcgaggatgtgaggcaagtgcggttcaactttttgcaaattttggcaaatttgcaccgcactttgattcaagccatcggctgcctttggatgaaagcaaaaggtttgcaatgtcgcagacagggtttgatgatcaataagtaataaattttcagccaaataaaagacataatcagggcaactcaaaccatcgtcttttaattgaatattttccataggaataaaattggtgactaaatcataagcaaataatccccctaagaaaatcggaatatcgctatgctgataaagcgttgttaagcaacgtaatccatcaaaaatcgacggggcgcttagcttactgtcttcatcaagatttgggtttggcaaagaaaacttcaccgaaagatgatgggtatcaaacgaacttatttcacaaataggctgtaattgttgtgcgatgtagggtaaaaccccttgcccatttaaggtcaatgcctcgaaatcaacttgttgtccttggcaagaaatttttaatgcggcatctactagcaacaaactttttaaactgtttttactttggatttcagcggactctaaaagcaaggtattttgtcggttttggcaaagtgtcgcaaaaatggcgatgggatcattacaataatccacatgatattctttggtttggataaaaacggactgcatttttaacatcctggcatttgttaattttgtactattaaactagtataaattaatattgtcaactttttttagaaataattattggatgaaggaaggattcaagagaatatgaagtaggttttgggatatttagagaagggcaaaatggggttttcattaaatcaaccccattttttcggtaatatgaccgcacttgaaaggaatgactattttaatcctttcactaagtaatgaatctgccatgttaaaagttgtttataagcctgaattcgcacccgttttttatcactcactggtttcaactcggtaactcaaagattgtcaggataaagtgcggttggattttgccaagaatattgcgtgagatgctcgccatcgctcaccccttcgctatcggcataaagcccttcgttataagcaaaagcatatttttcattgtcttgctccgccaacaaattgtgcccgcctaggttccaatattccgcatctgataagcttaaaccatataatgtaggcataatatccttgtgcgaaccaatgcggcttggatcaaatttaagggcaagtttgctctgtaattccgttggaacatgaacataaaacggtacgcccattgccataaaattctgttttggcgcatcgaaacgcacgctgcgcacgtggtgatctcctatagcagcaataatggttcgatttcccaccgcactttgcgccacttgtgtaataaattgccccaaggcgttattagcatattgataagtggaaagggatttgcgattttcttcttcactgccaaattttccttctagtacttgaggattaatacgctccgccttgtaatgttgaggtacttcataaggcggatgattcgtcatacttaatatattgataaataaaggttcattactttctttcagtaattgttctgctaaggcaaaggcatattcatccgcaatgccccaataagacatggcaggttttgcatcaggaaaagtttcgataatatcattttggtcataacattcatccacaccttgcaacggcaaataattgcctaagttgtgccacattaaaccaccagatgtgataaacaccgtacgatagccttgttgtttataggttttaaatgggctatagggcggggcgatttgctgtgcagctgattggctgatattttgaatagggctataaaaaagcaacgatgccaaagttggcgcagtgccgttataatcagaggtaaagcgtttgaacacaaaatcttgttcaaagtgcgaccgtaattgtcccaataaatcattggtttcagtgttatctaaaaccaaataattggtaccaaagctttccattaaggcaaatacaacatgaggtttgctttccttcaatgcaggattaacaggcgtacgctcaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaggcgtacgctcaatcaggctatctgtgccaaagacttgttgcattaaggctttaccttcgtctaaatcaaccgcctcaaaaagaatattgcgtttacgatctctaaatgcccattccacagcaattacgccatttgggactagtttattgataacggctaaagaggaaacttgcgcatgatctttggttaatggtttggagcgtattgtaccgcgtacaaaaaatgccaaggcaaggaatgggccaacaaaaagcaaagttgcaacagaccaatgcacatcccaatttaacaatccttggtataatgcataatacataaagtacgcaggaagcgcagctaacacaagcactgcgagagatcctgaaataacagggtaatcatcatagatatttttcaacacggctttggtatcgtcttccactaaaccaaacataaacatatcgtaataattgttataggttttatagtaataaaaattacccgccacaatgccaatgagcgcgatagcaaaaattaagatgtaaattgcccaaaaaagtgcggtggtttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggaacatttaaattttacggtatttcgtatgctgtttcacggctttacgaatttgtcgagtactggtacgacgacgggcttttgtcacatcaaccttagtttccgtttcaggttttaagccaaccaattcacgcaagtagttcacttgctctaatcccatctcttcccaaccaccacgcggtaaacttttttcaagtttgatattgccgtaacgaatacgaatcaaacgactaacttgaatcccttgcgattcccataaacgacgaacttcacggttacgcccttcggttaaggtgacatcaaaccattggttaatccctgtaccgccaactgctttaatctgtttgaaattagcaggaccgtcttccaactgcacacctttgcgtaaacgttgtatcattgcgtcattcacttcgccaaatacacgcacagaatattcacgctcaacctctctgcttgggtgcattaaacggttcgctaattcgccatcagtggtaaatagtagcaggcctgaagtgttaatatccaaacgccccaccgcaatccaacgagagcctgttaaacgtggtaagcggtcgaataccgttgctcttccttcaggatcagaacgcgtacagagttcgccttcaggtttgtagtacatcaacactcggcagatctctttttgagttggaattaggttaactaaattgccgtcgatacggattttggtgctcgagctaacctgtacacgatcacctagtgtcgcaattttaccatctacactcactcgccctgccgcaatcacttcttcaatttcacggcgagagccttgtcctgcacgagctagaattttttgtagtttttcaccgacgattttgtcgtttgctttattttccgtttcaatggaagcggttggtttcggcgatttttttacaagtggtttacgattttgggtttcttggcgtgtattactctgagtcggtttttgcaacgtttttgcagaatctgaccgcttggttgcagttggtttacgaaatgtcgtcatttaagttccttatttgtcgctttcacaagcgtcggggtgttatttactatacttcccccgcttgagggggaagatgcccgaagggcagaagggggggagcgtataatccctctccctccgaaaatccttcggattttctccaccctatcccgcaagcgggagagggatattatgcttcaaaaggtgtcggatcgcccgaacccactcgaataatttcagggctatcttgagttaaatcgatcactgttgtcggtgattgccctaagtaaccaccgtgaataattaaatcaacttgatgctctaaatgctctcgaatttcatcaggatccgattgggtaattgcttcattcggtaacattaatgaacacgaaagaatcggttcacccaaggccgaaatcagtgccaaagcaattacattatttggcacacgaataccaatcgtcttacgtttagtcattaaacgacgaggcacatctttagtcgctggcagaataaaggtataaggatttggcacattatttttaatcaagcggtaagattgatttgtcactagtgcataagtcgaaagctctgataaatcgctacatacgagcgtaaagttgtgattttcaggtaaacgacggattgccacaattctgtccattgcgtgcttatcgccaatcgcacaacctaaggcataaccagaatctgtcggatagacaatcacaccaccatttttgatgatttccactgcttgattaattaagcgttgttgtggattttcggggtgaatatagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgcattttgcgcttccgtgtttttgtaaaatatattttagcggtaatgaatttttaacaatttgaatgtgatcacagtttattttgagtgactcttataaaatctgaacgtcatttcatataggaggcaattatggttgactcacgttatgcttcgttaaaaaaaactgactaaatatcctctagcattagccagaaaacgtagggtgcttttctttctattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgcttgtttttgctttttttatggcacagcttctttcagatccattatttactccaactcaaagaaatgtgatgtttttactcttttttgcgatttgtttatgggtaacggaagctattccaccgttttcagtaggtattttaatcatcggttttctcgtgttaattatgggaaggcacgatgcacaaaatgcaatgaaatatctacaaacctggtcggatagtgttatttggctctttctaggtggttttttccttgcggaagcaatgaaaaaaaacagcgttagatacgttattgttgaaacatttattacctaaatttggtacagaccctcgttatgtactttggggattaatgttgattactgcactaatgtcaatgtttatgagcaatacagctacaacagcgatgatgattgcgacgattagtcctatttttgcgaccctagacaaaaaagctaatctatctagagcattactactaggcattccagctgctgcttccattggtggaatgggaactatcattggctctccacctaatgctattgcatttagtacagggctaattcaacaatccgaatttagattagggggaatagttattggtttattaggtcctgctttgagcattatatggggctggtttattattgagttgctttactaatcaatagaaaaaaactaaaaaggcagtcgctaaaataggaatgataacttagtgactgcatattttatttctgatgactaatttttcacagtatctagaataatgttttgtaattgctgcagcccatttaaccttgtacttgtcaaatggcgagttatctgcaaatcatcaaaaagcggttgaatttcaaaggattgcaatgcttcagctgatttttccgtaacaaaagcaatcaacaccactaacaatccttgcattaaacgagcgtcgctataaccttgtacttgacgtggctcaagctgaaaattaaaccataaacggctttcacaaccgtgaatttcttgccactgttcaagctgttgttcggttggtttgggtaattgacggcttagttgaattaacaagcggtatctttcttcccaagatttgcaaagggcaaactgggcattgatttcatcaaatgtcataaaatccctatccaagtatcggtaataaaagagctatatcatactgcgattttttgttaaaatccctcgatttttaccaatttgtaatgaggagcacaaaatggctgtaatccctatggtcgttgagcaaagctcaaaaggcgaacgtgcctatgatatttattcccgtctgttgaaagaacgtattattttcttaaatggcggtgttgaagatgaaatggcgaaattaattattgctcaaatgctctttttagaagcagaagatcctgaaaaagatatttatctttatattaattccccaggtggtgtagtcacggcaggtttagcgatttacgatacgatgaactttattaaacccgatgtatctacgttgtgtatggggcaagcctgttcaatgggggcatttttattatctgctggggcaaaaggtaagcgttttgcattacctaactctcgtgtgatgatccaccaacctttaggcggttatcgtgggcaagcgacggatattcaaattcacgcacaagaaattttaaaactgaaagagatgctgacacgcaaaatggcagaacattgttcacagccttttgagaaggtggctcaagatacggaacgtgataattttatgtctgcggaagaagcgaaagcctacggtttaattgatgacgttgtaacaaagagatagtgaataatggcaaattttgagaaagaaccacattgtagtttttgcgggaagcgtcgtaatgaagtcgatgcattaattgaaggtacagaagggcatatttgtaacgaatgtattgatgagtcttatgcgttaattaatggaacagacgaaccattgattgatgaaaatgaagctgagagccaagatgtgttaggcaatgtgcctaccccacacgaaattcacgcacatttagatgattatgtgatcggtcaagaacacgctaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggtattgtccgttgcggtctataaccactacaaacgcttacgcaatgcactgtctgacaataaagagagtgagggcgttgagttaggtaaaagtaacattttgcttatcggcccgacaggaagtggtaaaacattgttggcagaaaccttggcacgccgtttaaatgtgccttttgctgtggctgatgcaacaacgctgacgcaagcaggctatgtgggtgaagatgttgaaaatgtgatccaaaaattgctgatgaagtgtgattttgataaagatcaggctgaacgtggcattatttttattgatgaaatcgacaaaattacccgtaaatcagaaaatccatcattgacccgtgatgtatccggtgaaggggttcagcaagcgttgctgaaattgattgaaggcactattgcgaatatcaatccacagggtggacgcaaacacccgaaacaagaaacaattccagtcgatacgtctaaaattctctttatctgcggtggtgcatttgctgggctagataaaattgtcgaggctcgaacaaatacacaaggcggaattggctttaaagcggaattgaagaaagataaagatcgtcaggcactcactgaattattcaaacaagttgagcctgaagatttggtgaaatttggtttaattccagagctaatcgggcgtttgcctgttatcacaccgcttgaagaacttgatgaaaaagcacttattaacattttgacagagccgaaaaatgcgattatcaagcagtatcaagctttgttcaaaatggaaggtgtggagttaaaattcaccaaagatgctttagtggcgattgctcaaaaagcgatttctcgcaaaacaggggcaagggggctacgttctatcgtggaaaacttgttactcgacacgatgtatgatttaccatcattgaaagcaagtaaagtgacagtgagtaaaaactgtgttgagaaaggtgaaaagcctaaggtggagtaacttaattgatattctccccgtcctaagggcgggaatttttactagaaacttttccattactgaatcaagttaactaatttggtataaccgaacacaaaatttggtaataaacttctccacatttacctaagtcattcacattcacacattcattcactttatgaatggtttggtttatggggccaaactcaaccacttctgcacccattaaggcgataaaacgcccgtctgatgtgccaccgccagtgtctaatttaggtgtaatttgtgttacgttttcgaccgcttgtatcgtggcttgaaccagttttccgttgtctgctaaaaacggttttcccgacaaattccattcaattcgatgctttaaaccgtattttcgcaacatttcggcaactttggttttgatgatttcatcatttacttcggtgcaataacgtaaattgaactgcacataaagctcgcctgggatcacgttattactgcccgtgccagctttgatattggcaatttgcaggcttgtcggtgggaaaaattcgttgccgttatcccattggtaagcggtcagttcacttaaaaacggcagagctgtatgaacggggttttcagctaaatggggataggcgacgtgtccttgaatgccttcaatataaagattggcggtaattgagccacggcgaccgtttttcaccacatcgcctagctgtttggtgctggacggctcacccactacgcaatagtggatcggctcttggcgttgcattagggtttccaccactttcaccgtgccgtctttggctgctgcttcttcgtcagaagtgatgagtaaggcaattttgccctgatggttcgggttgtttttcacaaaggtttcacaagcgatcaccattgccgctaaagaacctttcatatccgccgctccacgcccgtaaagcatatcatcaacaatttcagcggaaaacggcggataagtccattggctttcatcgccctcagggacaacgtcagtatgtcctgcaaaggcaaggcaaggttcgccttcgccgtgggttgcccataaatttaaggtgtcgccaaaaggcaaccattccagcttaaatccgaccgcttgtagtcgttcggcaatcagttgttggcagccttcatcattcgggctgatagatttacgttggataagagatcgactaagagagataatttgattttgcattttatttcactgtatttgctaaattattgaaaccttacaacaggtatatgcctatttttctttatgaagaaaattaagaggattcaaattttagcaataatcccccacaaagtcgaaaggctaataaagggaataaaaggtaatcgggcaagtttttgcttggtgaataaaaaatagagggcataaaacactaaaccgaataaggaggcataaagcagtaataaaatcatctcttcaagggtaaacaaaggcgataatgcaataaagagaagaatatcccctaaacctaaactctcttttttgtagattaactgactaagcagtgaaaataagctaaaaaagagaatagtgataaaaagtgaaaaaatatgggagtttagctcaagggaatgataaaaaagcagttgccataatgctaagataaaaataatcgaaacatagcgaatatccgttaaataatataaataatccaataaagataaatatattagacagataagaataaaaataagcggtaagttttcctcgtaaaatatccaaaccgtaataggaaataaaatataaaaaccgtaggataaaaacgtaaatttaggctgtaagctagatttatggataaaatccgtcaaacttaacggcgattggactaataaattataatcctgataagtctgctgattaattcgcattggaaaatgttgcatttctttttgaaaccaataagcaagtaaaatcgacaataaaaataacatcattctatcattgctcccatatcaaaaatcggcaaatataacccgactaaaatagttcctacaataattcccattaacaccattaacatcggctctaataattgggaaagtatatcaatttgataatctaaccgctgttgataaccgtcgctgatttgttgcaacattggcgataattttccgctctgctcgccaatggcaatcatctgtaacatatccgtaggaaagagttttggatctaaactgtcggctaaacgatagccttgttttaaataagttagtgtagttgctagagaaccttgtaataaaatatcatcacttttattggctaaaaaggaatgaagtacagtatctaaacgaatatgtgaagccagcattaaactgctattttgacaaaaaaagataatgcgtgaatactggataatgccttttaaaataggaatatggcttaatataataaactttaggcgtttaataagatctgtttttttatttaaaatatgaattaatagaaaacataacacacataaaataattagcgttaaaatagagtgttgtagaaaattggataggctaaagagtatttcggtaattaaaggtaatgattttccttttgagccataaagttctgcaaattgtggcacaataaaaagtaataataaaatagagagtgtgattgaaatagctaaaataaagacgggataaaagagaatttttttaattttcttggctaatttttccgatttttcacggcgttgtgcaatattggttaaaatcagccctaaattaccgcttgtttctgccattttaattaattggatctcttgtggattgatatatttcccctgtttttcaaaggcaacggataaggcaaagccagcttcaatcaagcggattgtctcttgttgccaacggtaaaaggtgcgattttggcaagtttccagcaacattaccaaactctgttttagggggattttggcttgaattaataatgccaactgttgcataaattgattaatttcttcctttttcggtgccgtcggcaaggcaaaatgtcggctaatgcgtaactggctatagcctttttgttgcaagcgtttttctagcacttctcggctttcggcaagctgtcgccctgtttgcttttgtccaaagcggttgcgtcctttccattgaaattcataaatgttattcatcgcctaataccctatccacttcgatttcgttggttagttgttgttcaattttttgtttagcactctctcgtaagctggaaaaatctaagtaagcggtctgtttatcgaatttttttgcagttctacttaaacattggtaaatcccgatccgccctttatagccttgatagcactcgtcacagcctgtgccacgacactttttgcagagcttacgcacaaggcgttgtgcaatgactaacagtagtgaattttggatttcatactcttgaatacctagttgtaacaaacgttcgaccgctgatagtgcgtcattggtatgcagggttgaaaggactaaatgccccgtctggcttgctcttaatgccatttttgcactctcttcatctcgaatttcacctagcataatgatgtcgggatcttggcgtagaaaggtgcgtaacagctggctaaaatcaaggttaatactttgattgacttgggtttgaattaagccgtcaatctcaatttccacgggatcttcggcggtgagaatatgtttatccatttggttgagatagtttaaggcgctgtaaagggtgatacttttgccactgcccgttggtcctgtcactaaaatcagcccttgcggttgtttcaaggcgttgagtagtgtggtctgctgttgtggattaaagccaagttgtagaaaatcaaaactggttggtttgtttttttgtaggcgcaataccagtttttcgccgtagatcgtcggcaggctagatacccgaaaatcaagggtgtccgcmaaggcggtagtaaagctaaattgcccatcttgtggctggcgtaattcactaatatctagcttcgccagcagttttatccgtgaaataagtcggcttgccagttgaatagacaggcttttatacaggtgcaaaacgccgtcaatgcgtaggcgaataatcaatttttgcttgcgtggttcaatatgaatgtcggacgcattttgggctaaacagaatttaaaaagattatcgagcagttgaataatcggatcgcttaagttgagctgttcttgctcttgttctgcgaaagccagttcgctctcttcataaaagggctgttgctcaggcgagagtgcgttaagcaagtatttaagctcatcagaagcaatcaccacaggctcaatctgcttatgggtcataaaagcaaagatttcgcaagcggtgagattgttttcatcatcaacggcaagccataatttatgctcagtttcttgcacaggaacggcaagataacgcaataacagctctttttcttcgcaattttgttgccaacggctaggcgatatatcaaaaatgcgttcggtttgttgttcgcagacggtgtattgggacatagttaatccttggttatataggggtaggaaagtcccaccccatttgtttacggtgtagctttctgcccacaaaaattcgcagggaacaaactaatgtcagccccttgacagcttgttgcccaagtgatgttgttattggcaaatttcggggtcattgtgtagccgtagccatcaatattgcctttacctgccacggtgattacccccgaagcgacggaaatagatttaagatattttgcgtcagggacatcggatttatctgctcgaacgccatttttacctgaactacattccgagatttttttatcccctacgttataaatacaaatttccacatcggatttataagatgcggaagcacttaataactcagagagagctgccttttgggtgtaactggtgtaagacgggattgctattgttgctaaaatggcaatgatggcgatcacgatcattaactcaattaaggtaaaggcttttgcaagcggtcgaattaacctgatttttttcataaattgtccttctaaaatgaatgcgtaggatttacgccctatttactctgccactttttataaaaaatgcgacgagcaacatttattttttcgacgtagatcgaaaaaatcgttttttcttcctgtgcatttacacagtatttttgctaaaatagggcaaatttttgatttgagagtgaaagataaaatggcaaaagcaccaaaaaccgcttatgtatgtagtgattgtggcgcggaatatgctcgttggatggggcaatgtaaggcgtgtttagcgtggaacaccattagcgaagttcgactaatttcggcaaaagagagcaaaagtgaccgcttgagtggctatgcaggggaaacgacaggcaaaattcagcgattgtctgacattgatttgcaggaagtgccacgttttagcagtggtttttatgaactagaccgtgtgctggggggcggtattgtatccggcagtgcgattttgatcggcggacacccaggggcagggaaaagcaccttgctcttgcaagtgatgtgcggtttgtcgcaaagtgcgccaaccctttatgtgactggagaagagtcgttacaacaggtggcaatgcgagctaaccgtttgggcttgccgactgataatctgaaaatgttatctgaaacttcggtcgaacatatttgtaatcttgccgatcaggaaaaaccaaagctgatggtgattgactctattcaagtgatgcaccttgcggatattcaatcttcccctggcagtgtggctcaagtgcgtgaatgtgcggcatttttgacacgttatgccaaaacacgtcaagttgcgattattatggtcggccacgttacgaaagatggaactttagcaggccctaaagtgctagaacacgccattgacgcttcgttgttattggaaggggaggcggactcgcgttatcgtaccttacgcagtcaaaaaaaccgttttggagcagtgaacgaactcggcgtatttgcaatgacagaacaaggcttaaaagaagtgaagaacccttcggcgatcttcttaagccgtagcgaagaacagacttcaggcagttcggtgatggtattatgggaaggcactcgtccgttgttggtagaaattcaggcattggtcgatcactcaatgcttgccaaccctcgccgtgttgcggtggggctagaacagaaccgcttatcactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaccgcaagatttggtggtctttggcgaagtgggtttagcaggggaaatccgccctgtgccaagcggacaagagcgaattagtgaagcggcaaaacacggctttaaacgagcgatcattcctcacggcaacgccccgaaaaaagcaattaagggaatggaagtctttaccgtgaagaaattaagtgatgcgttggatattgtgaatgatctataagcattaggaaaatgataggagctataattaaactcctatatgttctcccattctatacttcagacaatagtgatgctatcaagaactgatagcgttctgcctgcaccgcttgttttaaacgctctgcggttaaaatgctttttaattcggataatgctgtttggaaatcatcatttacaatcacataatcaaattcattgtagtggctcatttcagaaacggcttcactcattcgttttgcaatggtttctgccgaatcttgcccacgaccaattaaacgtttttctaattctgcttttgacggtggcagaatgaaaatggttttgacatttggcacttttgcacgaatttgccttgcaccttgccaatcaatatcaaggaacacatcaatcccttgctcaaggctacgttcaatcattggcaatgatgtaccgtaatagttaccaaaaacttccgcccattctaagaaatgtccttgttcaatcaggcgtttaaattcatcgtgttgcgtgaagtaataatgtacgccgtgttcttcacctggacgtggattgcgtgtggtgtgggaaatggaaagttgtacttgtgaacgaggaagatccgaaagtaacgcattgattaatgatgattttcctgcaccacttggggctgagatgatatataaatttcctaagctcataatttatttagtgttgttctcacaatggtcttgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacttttaccaataaagctgcccgtgaaatgcgtgagcgtgtggcacattctatcggtaaggaaagtagtcgaggattgacgatttcaacctttcacacccttggttttgagattttaaaacgtgaacataaattactcggctataagtcggggatgacgctgtttgacgaacacgatcagctggcgttgttgaaacatctgttgcctgaaaatgtgacggaagataaagatctgttgaaattgttggtggcgaccatttctaactggaaaaacgatctgcttttgcccgaacagacgattgtcttagcaaaaagcgatcgtgatcgggcgttcagccatttttacgatcaatatcaaaatcagctcaaagcctacaatgctttggattttgatgatttaattatgttgccgactttgctgtttaagcaatttcctgaagctaaagagcgttggcagcagaaaatccgttatttgttggtggacgaatatcaagacaccaacaccagccaatatgaattgattaagctgttggtcggttgtgatggcaattttaccgtggtaggcgatgacgatcagtcgatctactcgtggcgtggggcaaagcctgaaaatatggggcggctgcaacaggattttccgaagctcaaagtgattaaactcgagcaaaattaccgctctagtcaacggattttgcactgtgccaacattctgattgataacaacgatcacttgtttgataaacgcctcttttcgcagttgggcgaaggcgaaaagctcaatgtgattgaagcaaaaaatgaagaacaagaagctgaacgtattgtgggtgagttgattgcacaccgtttttcacgcaaaaccaagtataaagattatgcaattttatatcgtggcaatcatcaatctcgcttgttggaaaagttgctgatccaaaaccgtattccctacaaaatctcaggcggaacgtctttctttgccaaagccgaaatcaaggatatgttggcctatctgcggttattggtgaaccaagatgacgatgcggcatttttacgcattgtgaatacgccgaaacgggaaatcggggcggcgacgcttgaaaaattagggcaacttgccaatgaaaaacaggtgagcctatttgaagctatttttgattttgaactgatccaacatttaaccccaaaaccgtatcaagccttgcaggactttgctcgctgggtggtggaattatccgatcaagcggtcagatccgagccgaaatctgcaattcaggatatgttggcgaaaattcaatatgaagcctatctctacgaaacggcagcaaccccgaaatccgcagaaatgcaaagtcgcaatgtgcaaacactgtttgaatgggtggagaaaatgttggaaggcgatgaactcagcgagccgatgagcttaaatcaagtcgtcaccaatttgactttaagagatatgatggaacgtggcgaagatgatgacgaaagcgatcaggtgcaactgatgacattacacgcctctaaagggttggaatttccacacgttttcttgatcggtatggaagaaggcattttgccacaccaaaccagtattgatgaagataatgtggaagaagagcgtcgtttggcttatgttggcattacccgtgcacaacagacgcttactttctctttatgcaaagaacgccgtcaatacggtgaagtgattaaacccgaaatcagccgatttttactcgaattaccgcaagatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaccgcaagatgatttgcaatgggaacgagataaacctaaactgagtgagcaagaacgccaacaaaaagtatctgctggactgaatagcttaatggctatggtacaagcgaataggaaatagaatacttcatgttatcgaacaatttgtattaatggtgaaatatcatcgtttacaaagatttctttttcagccattgaggctatttgttcgtgggaatattttttggcgttgtatacaacaactatgcttgtatctccaatatgtaaaaagtgattttttccaaaatctgtgtaacacgttgctccgatactaataattgctttattgggataatctgcttttttaattagttcagatatattattcattggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcttgattgggttggttgttcattctatcaatgatccaagctaacaatttctgatggaaatagctatagctaataactggactatctaccccatattccgaaagtttgccatcacgtttatgaaaacaggcaatgtggtagctatctaaatttcccccctgttcaaatttatctaatgcaatttgtgcagaagaaataccttttgaatgggctccccaatttttcttttcgcaaattttacgggcatcaggccggcgaattgaacaatcattataggctgcaaaatgtgttggttttaatgcaatcacacgaccttctttatattcaatatcacaaattaatgcaacttcaggttcaatttggagattatctgctttctcaggaaaaacaatgatatcgtgagagagagggtatgttgaaagaaattgttcatttttgtctagatgttcgctaggaacataaaagggaaaaatagcttttggttgatgaacttcgctagtttgaattttcacaaaatccctatcctctccagcttgttctaaatgcccagtaaaattaccagcaacgcccagtccaatgaatttagaattttccatacctaatctccaagaaattcaatatatgtaaatattattttactgattttatacagaaataacgataggtattgtaactatttgttattcaggcagttctttttaatacctattaatatgatacatgtttttttgtaagttgtatttgtttttcaataagttagcattatactgcacagattttaacatcggaatcccatagtgttcaaatatcaatgtacgggaatatttcgtatcaatgataattgaatatcaatttttcttaagagagtcaatcaatgaaaaaatgatattgagagtggttaataaccatcaaacaaaagacattgttttgaacggtgctaaaacggctgttcaaaaagcagagaaaggaacaaaataccaactagtagatgaacatggaaatttaattactaatgctaaagcggaagttgttggaaacgatcttgctatttcggtagaaggaagtcagcaacctagtttagtgttacaagattatcaactacattatcctatagaaaatgtacaatatttagcaaatactcaagcctcatttgctacagcagaaagtgccgcagctgcagctgagatttcggcggttgcttccacaagtatcgcatcaacattaagtacagcacaactggttggtcttagtttaggtgcggtaactgcggcaacagctggcgttgtatcagaaacagttagaaaccatacgagtaaatcgtcttcattctcaaaatcatcaatgcaatcaaattatgttgagaatagtgtaccccaaattactctaggtcagattaccaatgataaccttattgattatatagaatctcaacaggaaaaaattacgatcactgggtctgtgactaatgcaaataacggtgatattgttacgttgaaagtaggggaagcagtatcaactggtctggttacagatggacgttttgcgattgaagttaccgcaaaagataagatggataacccagcaaaagctcctgtagaaaaagaatatcaagttgatacgattgcacctgaagtcaaactcggccttgaacctattgcaggcgataatgcaattagcagcgatgaacgttcgggcaatattacgatttcaggtagtgatgctcaggcaggacaaaccgtaaaaataatggtaaatagccaagaaaaatcggcagttgtagatagcaatttaaaattcaaacttgaagttccagcaagcgatcttattgcgaccgataaatatgtggtaaaagcaagtgttacaggcaataacaatgcttctgccaatactgctcgtgcttatagtgtcgataaagaagtcgttgctcaaattgatattaagaaagtgggcgacttttcgttaaatatgggcgaaattgaaccgcttgtacgcattaaaggcaatgttgagttcactgatgtctatgctgtgggtttaaatcacaaacgcttgcttgaagtgaaagtgaagtttggcgataaagtttataaggctggtttccacgataaacagttcttccttgatattcctgcaagtgaattagctgaattaaccgggaaggacgtttcattatcgttttctttagcaacaggcgttaagggtgactaccataacaatatttatgggctaaccaaaaaagatgatggttcctatgcgacttggatcagttatggtacaagaacacctgcagtgaaaacagtaactttcgacagtccacatttagaaagacaatctgataccagctacaaagcaaattacaaagcagaacaacaggttgaggtaagcggaactgttacagcagcggcgaatagctctgtgaaagtcggtgatactgttgtggtcaaagtaggtgaaaagagctatgaaaccaaagtgcaagcgggtaataccttctcgacaatggttgataaaaaagccttggtccaaacggataaagtaacagcaacattaacaactaaagacttggctgaaaaagagatccaagtaactgatgtagagagagttgtaacaccaagtaatataagcagtaagcacgttattgtacaaaatcaaccaccgaaagagattaataatgatcactctactgatggctataatttcccttattttattgaaaaagtgcaagatgatcattcacaagcgggttggagcacggcttattttgtcaaacgtttaggtggatttggtctgagctacaatgtaccggcaggttcaccgcaagagaaacctgcggtgattaaatattatttccacggttcagagcaattggagtttgaaacaggcggaagtgttccaagcgatgcgttacaagatacgagattgaaagagatttttagagaggtttatgatcaatactcaagctatcttaacgttgaatttgtggaaagtaaggtggttcctgttacagatagacaaagtttagtgattaattttggcaaaatgacgaacggttctgctgctgtggcaatgagcgggggaaatatcacttggaatgcagcaaatgattataagagctggggcgaggattacagttattacaccgcattacacgaaataggccataccttaggaatgccgcatactgattccacaacagaatttggtaaagactatttgattgaagacagttctgagttttcagtgatgtcttataaccgttatgtaaacaatagcttatatcagaagttacattctttgcgaatgtatgatttagcctatttacaaaatcgttttggtgtgaatgcgaaatctcgtgctggagatgatgtttatacctttgctgattttaatacttacgcctccgatggtggtcgttatatttgggatggcgcagggattgatacctttgacgcatctaaagagcaagcaggggtctatgttaatttaaatccaggctcttggatttatgttggtgagacaaaagagaaaaatttcttgattaaaagcgttcacagtagtaagcaggacgtaaaaatatactttggcttacctgataaagcaacagtggatagtaatggggctgtgaatgcgcctctagatatttctgatgtcgaatatacaaaaggtcaagcctatatcggacaaggtacacaaattgaaaatctacttggttccgcacatagcgacactttaatcggtaatgccgcagacaataatatttacggcggagcgggtgatgatacattaattggcggggaaggtgaggatacttttgttttcaatgctagtttgaatggtaaggcagatgttattaccgatttcagtgctgaagataaaattgaattatccaaaacgatctttagtagtttaacaagtgcagataaagtgatagaacatattcaatatgattcatcaacagggaaattaagctacgatagtgatggaagcggaaaaggcaatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgacgtcaagtcatcatggcccttacgagtagggctacacacgtgctacaatggtgcatacagagggcgacgaagccgcgaggtggagtgaatctcagaaagtgcatctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaactgaaagggggcgtttaccacggtatgattcatgactggggtgaagtcgtaacaaggtaaccgtaggggaacctgcggttggatcacctccttacctgaatgaagagatttgcaagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaagagaacgagacatccttttgggtctgtagctcaggtggttagagcgcacccctgataagggtgaggtcggtggttcaagtccactcagacccaccactctaaacggtgaagagaaatctatactgaatagtgagtgaaacgaagaaagcgatgtgatgacattttggggatatagctcagctgggagagcgcctgccttgcacgcaggaggtcagcggttcgatcccgcttatctccaccaatcatcatatttaagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctcccaaagcgtaacggaggagcacgaaggtttgctaatcacggtcggacatcgtgaggttagtgcaatggtataagcaagcttaactgcgagacagacaagtcgagcaggtgcgaaagcaggtcatagtgatccggtggttctgaatggaagggccatcgctcaacggataaaaggtactccggggataacaggctgataccgcccaagagttcatatcgacggcggtgtttggcacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcaactattttgtctattacactgataattcaaatctcttgccttggcactgcattttgataaccaaactgtcgccacgcttcgtacaccacaacagcaacggaattagacaagttcatactacggctatctttacacatcgggatacggattttttgtgacattggtaaactatctaaaatcgctttcggtatcccacggctttcagggccgaacatcagaaaatcccccaattcgtactgcacatcgctatgattaggctcgcctttggtggttaaagcaaaaaggcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtttaggctttgctcgctcaagaaaatcatcaaagtctttatatttttgaatatcgacaaactcgtggtaatccagcccagagcggcgtaattttttatcatcccacgcaaagccaagtggctcaatcatatgcaaacggaaaccgcagtttgcacaaagacggataatattcccactattttgtgggatttcaggttcatataacacaatatctaacataatttattccgaatgtttcacaatccagcagttatgaatatgcggattacgctcaaaatccaacggtaatgttttgtgcgaaatgttttccgccgttaatcctaattcagccaagccgtcaaaatccattttaaagccacgtttgttgttcgagaatacaatcgtgccgtttgccgttaaaatgcgtttcaactgtttcatcaaggcaatatgatcacgttgtatgtcccaactgttttccattcgttttgaattagaaaaggtcggcggatcaacgaaaatcagttcaaaacgctcacggcaatccgctaaccattgcaagcaatctgcctgatgcaagcggtgatttcgtagtgaaatattgttcagctcaagattttgttccgcccagttgagataggtgtttgacatatctactgtcgtggtcgattttgctccatttaacgctgcgtgaactgtcgctgaacccgtgtaggcaaacagatttaggaaggtttttcctttcgccatttcgccgaccatcttacgtgttaagcggtggtcaaggaacaagcctgtatcaaggtaatccgtcaagtttacccatagcctcgccccatattcattcacgaagaaatagtcgcctttattcgccagtttctcatactgattagtccctttttgacgttggcgaacttttaagactaatttatttgtttcaacaccggtgacatacaaggtcgctgataccgcatcaagcaagtgcttgcgagctttgttttcatcaatatttttcggtgcggcatactcttgcaccacgatatgatcgccatatctatctaccgccaaattatattctggtagatcggcatcgtataaacgataggcatcaagcccttgctgttttgcccatttttcgatcttcttgatatttttggttaagcgattagcaaaatcaggggcaacctgtgcgttttggctaaattgcagattttcatcaagatctgaccgcttgtctgcattttcgctgatcaaatagttcttctgcacacactcaagcggtccgttctttgccttaaattgacgagctgaacgcagacgtaagcagttcagtaattcaggttcgccactaaaaatggaggcattccaacctgcaaattgctgttttaaccgttgcccaaagacagaatacaacgcaattaacgctggggttgtacctaatcgctcaccataaggcggattacaaatcaccgtccccacctgctctgtaatcggatttttcaacgccgacatatcgccctgttgccactgaattaaatctgccacccctgcatttttcgcattctgtttagctttttgtagcactcggtgatcaaggtcaaagccgaagaacagcgctttgcttccctccccctgctcgcagggggaggtgccgaagacggaggggggcaggatttccccctctttcgcttcctgccaaacccttttccacagttcgatctgatgccccttccaactatcaaatccccaatggatacggttaatttgtggggcaatattggcttgcatttgagccgcttcaatcaacaaagtccccgaaccacacatcggatcgacaagtggcgtgcctttttgccagcctgaacgcaacacaatcgccgccgccaaggtttcacgcaacggtgctttccctgtttcttcacgataaccacgcatatgcaaggcctcaccgcttaaatccaaagaaataatcaattcttcacggtttaaataggcgtgtaaacgaatatctggacggattttatccactgttggacgagcaaaacctttacgctcaaaataatcgacaatgccgtctttcactcgcattgcaccgaattgtgtgttgcgaatttcacggtttatgccgttaaaatccacgaaaaaggtatctcgcggatcgaaaatgctctgccagtcgtaagcaaccacagacgcatacaaatcgctgtcgctgaaaaatttcgtattgattaagggcaataaaatacgggaagccaagcgactatgtaataacgcttgatacgccccttttaaatcagtggtgaaatgcacgccgccttgagccactttgcactgtgcgtgcgtaatctgctcaagttcggtttttaacatttcttcaaagccacgcgctgcggtggcgaaataggttgtttgggtcattgttttaggtcaatggaaaaaagttgatggaattataactgaatttcgttagatctttaaaatagctgctgaattttaacaactaatttaactaatctttattagactctcgctgaatacaccttaaacttactcgacttcgctaacacttaatgtctacaaaatgccttatccaataaatcgggataaggtaaaaaagcattggcaacaatgcgtagctcaccaccacggttaagatgttgtttagcttgggcaatcaactcttctaccgcacgatatgccgtatctacaccgtcgtggaaagatggatttgacacaatcagatcaaaacgcccgccaatatgggaaaagacatcacttgctaccacatcaccttcaagctgattttccgccagtgttcgcttacttgattccaatgccattgcgtgaatatctgacatcgtcagcttgattttcgggaattgctgttttaagcacgctccaatcaccccagccccacagccaagatctaacaccttccctttcaatccatcggctttattgaaggtggaaagcaacaatttagaaccattatccagttctgccgagctaaacactgcaggcaaagcaaacacatcaagatcgcccaaatggtaagatttccagaattttttgctatcaaaagtaggcacattttccagcctaaaatggtacaacccataacgacgagccgagtcaatcttggctatctcaccaaacggctcaagtaaattttccactgaacgcacgccgacacggttttcacctaccaccaataattcttgaccaactgacgcagtcgccagccattgtaacaactgaaattgacactcttgcttattcttcgtccagtaaaagactgctaagtctgcttgctgataacattccaagccaaattccacgttattataatggcgagcataatcaaaatagctactgaacaccgccacagactttgccatcggctgaatgagtcccgaaaaatcatcacgcacatcgccaaataacaatacatttttttgctcaaagacgctcagatggcgttcaagcacttcactttcgattgataacataaatttccaaatttaatgcaaaataatttctgcattttaccgatttttgctactattccccaactttttatgaggaaaaatgatgaatcgccgagatctgcttctaacagaaatgaatataccccaatggatacttgttaaaccgcaagtactcaaaggcgatgcacaaattcgcttggcggacaatataaagctggtagttatttgcgaagaagatcaccaacagactgggttatttcaagatgttttacgagccttgcaattaaatcacgagcaatatcaatggattagccttgagcaagcaatgcgtctgcaattcgatcatcaaccgattttctggctgattcaacctgaagaacaagcggtacaatttacaaaaaaatttgcaaatcagaccgcttggcagtgtgagtcttggcaaatgctttcccaagctacacaaaagcgagagctttggcaacagatgcaactgttttgtaaagatatggcagaataaaatgaaaacattagttaagtatattacagttttaggaatattattcagtttctttattgcctgtatttatcttttcaaaccaccttatttctacgcttatgcatgttggcttcctactttactgcaaggaacaccaacagaacaaagcttacccaatcctgttcccaatcaacggtttgcagatacttggcacggaatgcgaagtggcggacaaaacaaactgggtggaaaagtggtcagcgtaatgacgggatggacggtacattactatgctcacttggaagaatatggcgatataaaacgtcatcaatggattgagcaaggagctgtgattggcactgttggtgatagtggtaacgccaaaggtactccacctcatctgcattacggtatttatacaccgactggggctgttaatccttatcctttaattaaacaataaatagtttttttatatgaaaaaatttgctattcatcttttatttgcaatatttccgttgccaccgcttgtagctctatagaaacagccaagacaacgctaaacaacactgaaaaatgggcagcagaaatagatagagaggcaaatttctatcgtatcaacaataagttattggtaagcttgtgaaaaagtgatacccaataacacataattcattacatcactaatgttttaaggatattctgtgatagaacctattttagaaaacgacttcgaccgcctttttgagatcgaacaacaagcccatttagtgccttgggcgaaagggacgctgttaaacagccaaggcgaacgctatttgaatttgaaattatccgttgaaaaccgcattgttgcctttgcgatttgtcagtttgtgcttgatgaagtcacgctgtttaatattgcagttgatcctgcttatcaaggcaaaggctatggtaagcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcaactgttgcaagcgttgatcgctcagcttcaacaaaaacagatcacgacattatggcttgaagtgcgagcttcaaacacgacagcacaaaaactttacttctcactaggctttaatgaagtgacggtgcggaaaaattactacccaacccaagacggtgggcgagagaatgctgtggtgatggcgttatatttataatgagagatatatctctcgccaagtaacaaaaatggattttgtgtaacttataactatcacaaaatcctttttctgtttataatgcgtgatattttttaccgtagagaatttttatgcaaatcgaaccgcttacacttcaggcctatattgctgatcgttggcaggatattgctattttgacctttcaggctgattatagcctcaatgattttagctatctctatgatttagcagagattttaagtgataatgataaggcagtttcatttaactatcctgtggagtttttcccayaycgtagtgtatcgggctggtttgcatttttagatgatatagttccttctggagcaagtcggcgttattggttgcaaaaacttgatattgctcatttgccgacagctcaacaaaactatttgttattaaaacaaggtacgattgcacctgtcgggcatttacgagtgaagcaagcggtcagttcttttatcgaaaatgaaccccctcgcttatttgaaatagatgatgttatcaatcgccaagctgattttttggaatatgctaatcagcgtggggcaatggctggcggtgcaacgggggctggtggcgaagcgccgaaattattgctacgccaaacagccactcagcaagtttggattgataatctacaacaaggtgacgctgccgacgatttctatttagtcaagtttccgcgtggaaaacgcagtgcaatagattgcgacatattgagagctgaatttcactattaccacgaattagcctcaatgggttttgataccattgatacgacaaaaatgcggttggaagagggcgaacgttacccgtcgttatggttacctcgctttgatgtttatcgtaatgaacaggggaaaatggctcgatatgccgttgaatctgtttatgctatgttagaaaaaggggctggctctttgctggatcacgaaaaggttattcgtcagttgattgccaaaattgaaaattctcacctagttgaaacaggaatggcttttgataaacaggcttttgtgatcgagtgggtaaggcgagatttattgaatatcgcctttggaaatagcgataatcacgggcgaaataccgctttcttacgcaatcaaaatcgtatttggcttgctccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatgattttgccccaatgaaagcggatcctgaaggcattcctcgtacgacaatgtgggatagtaaaagtcaccctgcattagaattaggcggtgaatatcgttttgatctgattgcagaacagcttgatgatttatgttcagccgacaagttattggatgctttgcgtcaaacggctcaacagcttgtcgggcttaaagcacgtttagaagcaaggggcgttccaacggcgattttgacgtacccttcaatcagtttggactatttacctgaaaaattacaacgttggcaattattatcataatggaagagatcaaacaggctagagcctctaaaagtaaaaaaacgttagatatttatcagcgagcgactgtgcgagacgaaattgctcgtaagctattgctcaatgagatgagtttagggcaggcgttgaaatatctacgtttacatctactggcaatgaaacaagagcgttatgcggagattgtcaaagtttctcgcaaaacgttatctgatttagaaaatgataagggaaattacagtattgatattatcaatcaggtgttacgcccctttgaattacagcttggcgttgtgccaataaacaaaacattactcagacaagttttaaatgaacaagcggtctgattttcttaaaaattaacaagagaacaaaatgaacgaattaatcacctttgaagaattagatttaagccctgagctgttgcaagcgttggaaaaaaaaggctataaacgcccaacggctattcagcaagaaaccattccgcctgcaatggaagggcgagatgtgttgggttctgccccaacaggcacaggaaaaaccgctgcatttttactgccggcgttacaacatttgctcgatcacccacgccgtaagcctggtccgccacgcattttaattttaacgccgacccgtgaattagcgatgcaagtcgctgagcaagcggaagagttggcacaatttaccaacttgaaaattgccactattacaggcggtgtcgcttatcaaaaccacggcgaagtgtttaacaccaatcaagatcttgtggtggcgacacctgggcgtttgcaacagtatattcaagaagaaaattttgattgccgttctgtcgagattttaatttttgatgaagcggatcgtatgttgcaaatggggttcgggcaagatgccgaaaaaatcgcagcggaaacccgttggcgtaaatatacttggctcttttctgccaccttggaaggcgaattgttagtggattttgctgaacgcattttaaatgatcccgttcagattgacgcagagccaagtcgccgtgagcgtaagaaaattcagcagtggtattatcacgctgataatcttgaacataaaaccaaattacttgcccgtttgataagtgaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataagtgaatttgagattgagcgaagcattgtgtttgttcgtcgccgtgaaagtgtgcgagagctgagcgaaaccttgcgtaaacgtggtattcgttcgacttatctagaaggcgaaatggcacaaacacagcgtaatcaagcgattgctcgcttaaaagatggcgtggtaaatatgttggtggcaacggatgtggctgctcgtgggattgatattgatgatgtcgattttgtgattaactttgacctgccatatagtgcggatacttatctacaccgtatcgggcgtacagctcgtgcaggcaagaaaggttccgcagtatcgttagtcgaagctcacgattacaagctacttggcaaaattaaacgctatacggaagagccgttaaaaccgcgtattattgaaggcttagcaccacgcaccaaagccccaaaagatggtgaagtgaatacggtatcgaaaaaagagaaagcgcggattaagaaaaagaaagaagagaaaaaagagagtttgaagaaaaaagtgaaagttcgccacaaagataccaagaatattggtaaacggagaaagccgacaggggagcagggcgaaagctaaaaacaagcgggtagatctcacaccatttttagtaaatatcaaatattttcttaaaataatttgattgttgtttcatagtatattattgagactattataactttcaaatttgaggattgtatgaaaaaactcacaaaactgctatcccttactctgttatttgcccttgctggttgtcattctgtactggatgctccgactgaaatcactcaacctagtgtgacaattccacataatgatgcaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgcaaaatggcaacaacatcttgcacaattaacgcaaatcaaagcctattcagcgaaagggcaatttggctatatttcccctgaggaacgtttttcttcccattttgattggcaatataaaaccccgacgaactttgggctaacgatgtcctcaaatttatcaagcaaatcattgaaattacagcgtaatgcttatggaatgacgatttctgacagcgaggggcgttctcgtaccgaagcagatgtggctatgttaatggaagaaattatcggcgtttcgttcccgatagatcaatttgcctattgggtgaaggggcagcctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctattgggtgaaggggcagcctgagcaacagtcaaactatattgtcaatgaaaaacgccagttggctcaatttgattatgcggtcaatggtgttttgtggaaagtgcgttttgtggaatatcacgaagatcgcccgccaaatctgcctaagttgattgtgttggaaaatggttctcaaaccttgaaaattcgtattgatcattgggcgtactaatatggcaactttcacttttccaagtcctgggaaacttaatctttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaacttaatctttttttgtatattacaggtaagcggtctgatggctatcacgaattgcaaacgctatttcagtttttggattttggtgatgatattgagattgaacttcgccaagacccaaccatttgcttaaccaagcagattgatggtgtggctgttgagcaaaatctgatttatcgtgctgcaaaattgttgcaagaaaaaaccgcttgctcgttaggggcgaacattggcgtgacgaaacgcttgccgatggggggcggtgttgggggcggttcatcaaatgcggcgacggtgttagttgcgttgaatgaactttggcaaacagggctttcccttgagcaacttgctgaaatgggattaaccttgggggcagatgtgccgatttttgtgcgaggcattgcggcttttgctgagggggtgggtgagaaattaacgccttgtcagccgaaagagaagtggtatttggtgttaaagcccgacgaggcgattgcaacagcttcgatttttaagcaccccgatttaactcgtgatacgccaaaacgtactttaacggagctacttgatgcccctttcgcaaacgattgcgaaaaaattgtcagagatctgtattcaaaggttgatgatctactaaattggttggtacaatacgcaccgtctcggctaacaggcactggtgcttgtgtatttgctgaatttgattgtgaagatgaggctcgccgtgtgtttgcgttaaaacctgaaaatgttgatggctttgtggcacaaggcagaaatgtttcccttttacatcaaacgctcaatttatatccttaaaaatctacatctagaggtttatccaaaatgcctgatattaaactcttcgctggaaacgctactcctgaattagcaaaacgaattgctgaacgtctttatatttctctcggtgatgcaacagtaggtcgtttcagtgatggtgagatccaagtacagatcaatgaaaatgtgcgtggaggggacatttttattgtgcaatcaacctgtgcaccaacgaatgataatttgatggagctgatcgtgatggttgatgcacttcgtcgtgcttcggcaggtcgtattaccgccgtaattccttactttggttatgctcgtcaagatcgtcgtgttcgttctgcgcgtgtgccgattaccgctaaagtagtggctgatttcctttcaagtgtgggggtggatcgggtattaacttgcgatctacacgcagaacagatccaaggtttctttgatgtgcctgtggataacgtattcggttcaccagtattgatcgaagatattttaaagaaaactgatctggttaatcctatcgtggtttcgcctgatattggcggtgtggtgcgtgcgagagctattgcgaaattattaaatgatgcagatatggcaattatcgacaaacgtcgtccgaaagcgaatgtggctcaagtaatgcacattatcggtgatgtggcggatcgtgattgtatcttagttgatgatatgatcgacacgggcggcacattggttaaagccgcagaagcattaaaagagcgtggggctcgtcgtgtatttgcttatgcaacacacgctgttttctccggcagtgcggcgaaaaacttagcgaatgatgcgcttgatgaagtgattgtgacagacactattccactttcggctgagatccgtgcattaaataaagtgcgtgtattaacgttatcaggaatgttggcagaagctattcgtcgtatcagcaacgaagagtctatttctgcaatgttcagccattaatcaaaagcccaatcgaaagattgggtttttgatttctaatgtatggcattgatttttagaaagcaaaattaattcttcccccataaatgggggaagtcccttcgtgaagcgaaggggatggggcggaaaaggatatttaattctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgggggaagaattttctttctttccctcaagcgagggaagaattgtaattttatattgatacaaatgatgtacccacttatcaaaaaagcactatttaatcttgatgcggaaaacgcccatcaacttgcaattcaatccttaaaattattcggtaaaaccccgttttctttagcttgttcacttcccgacaacccgaccgaagtaatggggctgcgtttcaaaaaccctatcggtttagccgcaggggcggataaaaatggagaggcgattgatggctttgctaaattggggttcggttttattgaggtcggcactgtcacccctgttgcacaagacggcaatccccgtccacgacagttccgcattcttgaagccgaaggcattatcaaccgcaacggatttaataatcttggggttgatgtgctgattgaaaatgtaaaaaaggcaaaatataacggtattcttgggattaatattggaaaaaatgcgacgacccctatcgaacatagcttggacgattatcaaatttgcttacgcaaagtctatccacacgccagttatgtgacggtcaatatctcgtcgccgaataccaaaaatctacgttctttacaatacggcgaagcacttgacgatctgttacgctcacttaaagccgaacaagcccaactttcgcaaaaatttggggtttataaaccgcttgtcttgaagatcgcccccgatctcactgccgaagaaattgcttctgttgcggacagccttgtccatcaccaaattgacgctgtgattgccggcaacactacactttcacgagatagcgtcgcaggcttgccttttgcggatcagcaaggggggctaagtggtaagccgttgaatgctctaagtactcaacttatttcgcaactttctcaagaattaaacggcaaactgcctattatcggcagtggcggtattcattcggtccaatcagggcaagaaaaaatcaacgcgggggcaagtttattgcaactctattctgcgatgatttatcaaggtcctgatttagtacggcagttggttaggaaaatttctatttagggatggttttacaaacttccaagagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcccccatttatgggggaagtccccgagcttgcgagggggatgggggctagcgaggggaatacacaccagctaaacaatactcacatatcgatcaacatcaggaataaagtctgcttctttgctgtatccaactgcaatggtatattcatagctacctgagccaatagcggtaacattcgtatttccttttacaactgtcgcggcaatagaaatcactcctgatggcacctgtagagtaacaccatcatccaccactactaaggatatttgttctgccctatgggcatcagtcttaatcgattgacgggtaccttccgtcatttcatattcccaactaaagctataatatctaacaatccctgatttcttctaataacaagttgttcatcaacaattttagtgaaaaagactttaaggggttctcctgatttatcaacaagatgataagttttacctgaagccgcagaaagagttttattagtgagtgataaaggaatagaggagtacatagttaaaccttaatttgtcaaagaaaaatgaattccgaaaccgtttgccaaaatggatatattgtatttttttaaggggggtagtcaagcggaacgatgtgtagcaaggcaatcaggaggtttagagaggttttttcggtgtatagactaaagtttttatggggctaataattggggggaaatcttaatgttttaaggctaagttagattaattgatttgataatctaacgtagcactttgcatttttaatatgttatcttgtcccatacaccacgatagttttaccatgtgcagagattaacccttcatcctcaagcattttcaaaatacgaccaacagtttctcgtgagcaaccgaccatttgcccaatttcttgacgagtaattttaatttgcataccctgagggtgagtcatcgcatcaggcattttagctaaattcatcaatgtttgagcaatacgacctgttacatcaaggaatgcaaggttactaacctgtcttgatgtcattcgtaaacggcgagccatctgagctgagagatacattaagatatcaggatttagatgaactaattgcttgaattttttataagaaatttcagcaatttcacagttgcctttggttcttacccaagcagtgcgaggctgagccttttcttcaaaaaggctgatttcaccgacaaattcgccttgtcctaaattggttaataacatctccttgccttcttcatccttgataaagacagacacagctccgctgacaatataaaacagtgattcagcatcttcacctgcgtgaattaaagtatattttgctggataacgatgaatatgacagtgagttaaaaaccattccaccgaaggatcgtgaatggatggtaatgggctgacatcttcaagctgtgcggttgagattgaaacatcttgcatagaaacctctataaatcatttatagttgatatagcttaatactacgtcaagaattttagcataaatttacaaattccctaagaaagattttttatctttaatatcaatgctttcgtgcaattctgaccaaacaattacaactttatcggcttttaactgagctaataaacgctctcgtttttctgcgagcgtgagttctcgctccccataatctgttccttctcttaaaataaaagaatctaaaacattatatagggtgctttcttcaagttcttgccaagggataatcatctttttcctagtagaacaatggcttaatcagttgccactgtttttcaaaatgttgatgttgattaaagccaaaatttgagcgaacaaggcgtaaaaattgcccttcacagaaattcaccaagtaaccagccaatgctcgttcatcagcaaaagctctgccctcacgcaatttacgcatttgcaataaattcataaattgcagttctaatccttcaaagaattttgcgacacgagctttgagtaactcatcttcaaacattaatgcatgtcctgttagaatgcgtgtcacccctgggttcttttgtgcaaattctaagatagtttgtaaaatcgcttttactgccaattcggtattttcttggcgtttacttgcattgatatagctcgttaatgtcatctcaatccgttcaatcaaagcctcaaacatctttgttttacttgggaagtaacgatataacgccccttcagatacgccgaccgcttttgataatctttcggtcgtaacacgttgcataccttcttccgagttaagtagcccgattaagacttctagcacttgttgctggcgttcttttaccgattttttcggcattttgataacaggttctgtcattttcaatcctattgcttacctgaatgaccaaatccaccctcaccacgatctgtcgcagtaaactcttctacaatgttaaattgtgcttgcaccactgggacaaacacgagctgtgcgatacgatcacccacttcaacagtaaacggcttatcgctacggttccatagggaaaccattaatggaccttgataatcgctgtcgattaagccaatcaagttacccaatacgatcccgtttttatgtccaagccctgagcgaggcaaaatcaccgcggctaagtttggatcagcgatataaaccgaaatccccgttggaattaacactgtatgcccagcttctacggttaaaggttgctcaatcaatgcacgtaaatctaaccctgctgaacctgttgttgcataggttggcaaaggaaattctgtgccgatacgtttatctaaaatttttaagtcgatttgtttcattattcttccttttacaaatttccaactaaagctgaccgcttgttaccaagatttcacaaggcaaccaaccgatttctttgcctttactcactaatgcccattgataatgaagctccagtaattcaacaatatctcctttcactaccgccaattccgttgggttgtaatcggtcactaaatgattcgctcggacaaaatgttcaggcacataagtgtgatagccctcaatttcacaagcataccaattcggatatttccgacaaggtgtaagcgctttgatttcagtgcctttcacaaaagtaggaaaaataccttcttcaatggtataagatgtagtgacctgtagtttcatattcgttccttagagatggcggtaatgttctacaatctcatccaccagcttttccgccaatttccctttctctgcaagctgtaagatcttctcgccattttgccaaaagagatgaagtgtattttgatcttgcccgaacacctgtccgccagatacatcattggcacagattaaatccaaatttttacgttgtaacttatctttcgcataatcagccacattttgcgtttccgcagcaaatcccaccacgaaagggcgattttgagtaagatgggctactgttgcaataatatcgggatttttcaccagttttaaagtaagttcatcattatcaccagttttcttaatcttctgttctgctacctgttccactcggtaatctgccaccgccgcacagccgataaaaatcgcatttttctgtactaaattgaccgcttgttctgccatttgttgtgccgaaatcacatcaatacggctaacattttgcggtgtagccaaattgacagggcctgcgatcaaggtaacttttgccccacgtttagcaaaggcttccgctatcgcaaagcccattttacctgagctgtgattactgatataacgcacaggatcgatcgcttcacgcgttggccctgcggtaatcaccacgctcaaatcagcaagatcttgtgattgcgtaaaatgatcttcaatcgcttgaaaaatctcactcggctcagacattctgcctttgcctatatcaccacaggcttgaaagccagcgttaggtccaatgatcgaaacaccttgctcagtcaaactttgcaaattttcctgcacaatcgaccgcttgtacatctgctggttcattgctggtgcaagcaaaattggcgaagcggtcgcaaggcaaatggtcgaaagcagatcattgcccattccgatacgcaaccgagcaataaaatctgctgttgcaggggcaatcaccactaaatcagcccatttcgccaattcaatatgccccatcgctaattccgcttggggatcgagtaaagaggttgaaaccgcattacctgaaatggcttgtaatgtcagcggtgtgacaaaggcttctgccgcaggggtcattgccactcgcacttctgctcctgccgtttttaataaacgaattagctcaatggttttgtatgccgcaatgccaccagtaataccgataaggatttttttatcttttaacataacgaatcatctttatgatgggttttctacttgctattttacgcaaataggtactcactcacaacgccctatttttgcgatctttgtcgaaaaaagagaaaaagccttttgaatcaaggtgagaagatttttatgctgtttgcactttttaactaattgaacaaaaaatatgaatgaaagttctagtgaattaatgccaagagaaaaattgctgaaatttggtgctgaagccttaagtgatgctgagctattggcaatctttttacgtacaggaattaaagggatacccgtgatggatctatcggaaagcgtactcactgcctttggttcattacggggattgctgtcagcaacattagaagatttctgtaaaatcaaaggattaggacaaattcagtatattcaacttcaggcaaccaaagagatgacgaaacgctatttatcgcaacaaatgaaagtaaatgaaatggtagatagcccctatttagccgtaatgtattttcaatcggaattggaatcttgggagcgagaagtatttatggtgatctttttagataaccaaaataggttgatcaaaacagaaaaaatgttttacggtacgatcaaccaagcctcagttcaccctcgtgaaatcattaaagaagccttgaagtgtaatgccgccgccattttagttgcacataaccacccatctggcaactgcaatccaagtgaggcagatcggtttttgactcgaaaaatagaaatggcgtgtgatttagtcgatattcgctttgttgatcatattattgttggcaaaggtgactatttttcgttcgaagaagaaaagtttgaacaggaaaattacgaatttcccccttgtttagatgaactaaagcaagtataattcgcagtctttaaaatagtctgtgggtcgggtgtatgtacctgacgaggtcgtcagattgagttgagcctttctgatcgcccgaaccatttagcttaagcttaagtaatatcggagaattgaaaatgtctagagtctgtcaagtaacaggcaagcgtccagtagttggtaacaaccgctcacacgcaatgaatgcgactaaacgtcgttttcttccaaaccttcacactcaccgtttctgggttgagagcgaaaaccgtttcgtaactttacgcttaacagcgaaaggtatgcgtattattgataaaaaaggcatcgatgcagtattagctgaaatccgtgctcgtggcgaaaaaatctaaggagctaacaaatggcagctaaaggtaatcgcgagaagatcaaattagtttctactgctgaaactggtcacttctacacaacaacaaaaaacaaacgtaatatgccagaaaaaatggaaatcaaaaaatttgatccagttgtgcgtaaacacgttgtttataaagaagcaaaaatcaaataatttgcttacttatattaagaacccagcgaaagctgggttttttatttctattattttctcggtattctattaaattttatttgaaatgataataattcttatttataattatttctgagtgttttacttggtttttacctaataggagttttaatgtcgctatttgggcaattcagaaagttactttaacaacagacgttcgctacgaccatttcagcttaaatacattaggcaaacaaatagtactaaaattcatgcttctgaggggaaagttaatcctatcttgaatgtaatttggaatatcacctcaaacttggcattggagacaaaattgaattatgccagccgttccccagcattagccacagctaatactataacagataaccgtgcaaatttagcacaagttcgtggaaggagagatgttgatagtaatctaaaacctgaacaatcacgtctagcagaagtcggttttgaatggaaacattcaggagctagacttgtagcaagcctttttgatgaaaaagtaacgaattattactccggagttactgctcctactataacaaatcttggcaatcttagaactaaaggatatgatgccgaagcatcttatgaaattgcagggctaaaagttggtgttggagcaagttattcaagagctacccctgaaggctttaaactttcggagggtgttttggatattgtacctaaaggtcgccaatggaaaacaaccctttcctatacatttgagaatccaaatctagagataggatatagagggcgttatgcagaagctaaaacctttgtgattacgactagaagtggcgatgaaagaattcgtaaagctggctacggagtacacgatatttatgctaatctgagattactcaaagatgatttaagtctcgactttgctattaataatattggaaataaacgatatcaaagtcatagccaacgtttgcattcacatataaaccctggtcgtcagtacattattggggcaaactatagattctaattttttcataatgtgatctaagcggtaggatttacgaatcttgccgcttttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagactttcttaagatttctctgttttaatacactcaacaaagcaataatgcttttactaataaacactaggagcaatttatgaaaaaacttactttactttcagcattacttttatcaaccgttagcctttcagcatttgcggacaaaggttattatcaaaatggtggttttactaatagtcagcaagcggttactcaagccagccaagtatcttcaatgagcgatgatcaatatgtcgtattacaaggcaagttggttaagcagttggataaagacaatttcacattccgtgacgcaagcggtgagatcacggtggatattgacgatgatgcttggagagggctaaatgttaccccaaatgatgaaatcagactttatggtgaaattgataaatcactagtcggtacagaagttgatgttcatcgtgttgaaaaggtaaattaatgcgataataggaaagtggcagtaaatgccacttttctcttttagaatttggaggttgagatgcgtattttattaattgaagacgatccgttgatcggagaagggctaaaacttgggttgagtaaatccggctttagtgtggactggttcacggacggtaaaactggcttagatgcgttaagttccgcaccttatgatgccgtagttctcgatctcaccctgccaaaaatggacggacttgaggtgttacaaagttggcgacgggctaatcaagatgtgcctgtgcttattttgactgcaagagatacccttgatgaacgtatcacggggctacaacgtggtgcagatgattatctctgtaaaccttttgctcttgcagaggttgtagctcgtttacaagcgttgatccgtcgtcgttatgggcataccaaccctgtgattgaacatagtttagtgaagttcgatccaaatcaacgcaaagtgtttcttcgggagcaagaagtcacgctaaccactcgagagtacaatttgcttgagttatttatgcacaataaagatcgtgttctcacccgttctttcattgaggagaaactctatacttgggacgatgaggtcagtagcaacgctcttgaagtccatatctacaatttacgtcagaaactcggaaaacagtttattcgtaccgtacacggtgtcggctacgccttaggaaaaaacgatgaagttgcttaaaaataccagtttgcgttttcgcttgatgatcgtgatttcttgcacggcgttgcttatttggcttgtatccactgcagtggcgtgggtgcaagttcgtcacgaagttgatgaagtgtttgatgctcaacaggtgctgtttgctcaacgtttggcctcttcagatttacgcacattattgatggaacgtaagccacaacggactttcaacggcgaacaccataaaaaatcttttaaaaagatcgctttcgatgatgatgctctggcatttgctatctttaatgcccaaggggaaaggatattgagcgacgggcataatggtgcaaactttccatttaaaagagccagtggttttaccaaatcccgacttaatcacgaagatgacgatgagtggcgaattttttggttaccgattggtgatcgtttttttgtggcggtcggtcaagagcaagattatcgagatgatctggttcaaggaatggtgtttagccaaatgtggatttggttcgccagtttgccgttattattgggcttgattgtgtgggtgattaagcgtgaactattgacattgcaacgtgtgggggagcaagttcaacagcgaacgcctgatgataatagtccgctttcgactgatgttccgaaagagattttaccgctagtcagcagtttaaatcagttttttgatnnnnnnnnnnnnnnnnnnnnnagagagcgtcgctttacttctgatgctgctcacgagttacgcagtccgttagccgcgctgaaaattcaaaccgaaattgcacaattagctggagatgataccgctttacgtgagaaagccttgcataatcttactcaagggattaatcgtgcaactcaattaatcgagcaactgcttacgttatcccgtttagataatttaacggaattggaaggtgtagaagatattcattgggataaattaattccatcattggtgggggagctttatttccaagcacagaaacgagagatggaaattgagtttgaacaaaaaggcgtacctgcggttaaacaaggtcagccgttacttctttccttgatgttacgaaatctggtagataatgcaatgaaatattgccctcaaggcacgaccattcgtattacattagagccacaatgtattatcgtggaagataatggtggtggtgttgatgaggcagatcttgctaaactggggcagcgtttttaccgtcctgctgggcagaatgaaaaagggagcggtttaggcttgtcgattgtaagacgtattgcagagttgcatggttactatatttcgatggataatgtatacaatgtgaagggtggaaaagggcttagagctattattaatttatcgggactgtgccgtcaaactccgtcctgaaggatggagatataaggcacaaacggtgtgagccgtttcaaacctaactaagcaggtgtttgttgttgcttgatgtattggcgaataatcgaaatgggcgcattaccgcggcaggcatcaaatccgcagaattaaacagttctgcggttctgctcgttttgtgtttaatcgggcgttgacttggtaaaatgagcaatacgaagtagcctattgagaacaataggagctagtaggaattctcgccttttatagcggagagtacgtcaatcaatatctcctagactatattaacaaatttttctcttcccccttgaaatttccagatagagatctaataattactttctattactatagttatttctaattacaataatgaggagttattcaatgaaaattcgtccgttacacgacaaagtaattttaaagcgtgaagaaatcgaaactaaatctgcaggcggtatcgttttaactggttctgcggcaactaaatctactcgtggtactgttattgccgttggcaatggtcgtactttagataatggcactgtgttgccgttaaatgtgaaagtcggcgatgtggtgattttcaatgaatatggtgtgaaagaagaaaaaattgatggtgaaaccatattaattctttctgaagacaatattttggcaatcgttgaataactgtgtagggacacactgcgtgtgtccaactacaacaagcggttaaatcattcaatatttttacaaattaatcacggacacacgcagtgtgtccctacaaggaataaaaaatggcagcaaaagacgtaaaatttggtaacgacgctcgtgtgaaaatgttaaagggcgtaaatgtattagcagacgcagtaaaagtaactttaggcccgaaaggtcgtaacgtagtattagacaaagcctttggcgcaccaaccatcactaaagacggtgtatccgttgctcgtgaaatcgaattagaagataaattcgagaatatgggtgcgcaaatggttaaagaagtggcatctaaagcaaatgatgcagcaggtgacggtacaactactgcaactgtacttgctcaagctatcgtaaatgaaggtttaaaagcggttgcagctggtatgaacccgatggatttaaaacgtggtatcgacaaagcggtagctgcagttgttgaagagttaaaatcgctctctaaaccgtgtgaaacgtcaaaagagattgaacaagtcggtacgatttctgcgaactcagacagcactgtgggtaaattaattgctcaagcaatggaaaaagtgggtaaagaaggtgtaatcactgttgaagacggcactggcttagaagatgcgttagatgtggttgaaggtatgcaattcgaccgtggttacttatcgccatatttcatcaataaaccagaagccggcacagtagaattagaaaatccatacattcttttagtggataagaaaatttcaaatatccgtgaaattctgccagtattagaagcagtagcaaaagcgggcaaaccattattgattattgcagaagatattgaaggcgaggcgttagcaaccttagttgtgaacacaatgcgtggtatcgtgaaagtggctgcggttaaagcgccaggctttggcgatcgccgtaaagcgatgttacaagacattgcgattttaactgcgggtacggttatctctgaagagatcggtatggaacttgaaaaagcgactatcgaagagcttggccaagcaaaacgtgtggtgatttcaaaagacaataccaccatcattgacggcgttggcgatgaagtacaaatcaaagctcgtgttgcacagatccgccaacaaatcgaagactcaacctcagactacgacaaagagaaactacaagagcgtgtggctaaattggctggcggtgttgcagtaatcaaagtcggtgcggcaactgaagttgaaatgaaagagaaaaaagaccgtgtagatgatgcgcttcacgcaacccgtgcagctgtggaagaaggtatcatcgcaggcggtggcgtggcattagtgcgtgcggcaagcaaagtggctgatgtagtgaaaggcgataacgaagaacaaaacgtaggtatccgtttagcacttcgtgcaatggaagcaccacttcgccagatcgtgacaaacgcaggtgaagaagcgtctgttgttgctcgtaacgtaaaagatggcaatggtaactacggctataacgctgcaactgaacaatacggcgatatgttagaaatgggtatcttagacccaactaaagtaacccgttctgcattacaatttgcagcctctatcgcaggtttaatgattacgactgaatgtatggtgacagatctgccgaaagaagaaaaagctgacctaggtgccggaatgggcggtatgggtggcatgggcggaatgatgtaattgctaagcagaccttatttgagtagtagagctaaacccgtatgggtttagcttttttcttttcaagaatgagtggatgatcccattttgtgatctagttcatatcttctttgtattatttacgctatactccacattattttaactttttgaaaggatactccaaatgagccagaaatttgagttaaatgatcatccgcaccgccgttataatccattgaaagacgagtggattttagtttctccacatcgagcgaaacgtccgtggagcggtcaagtggataaagcggcggttgaacagctaccgagttatgatgaaaagtgttttctctgtccgaccaatacccgtgtttcaggcgatgtaaaccctgattatcaaggcacttatgtatttgccaacgattttgccgctttgatgcaagatacgccagatgctccgccatctgacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccgttgtttaaaattcaaggggtacgtggtttagctagggtgatttgtttttcacctgatcacagtaaaacgctccccgaattgcctgtggaaaaaattcgtggtgtggtcgatacttggaatgctcaattagaagagctaggtaaagattacttgtgggttcaagcctttgaaaataaaggggcgatgatgggttgttcacaaccacacccacacgggcaaatttgggcgaactcgtttttaccgaatgaaattgcaaccaaggataaaaatttgcgtcgttactatgaacaacacggctcaaatttattggtagattatgctcaagcagagctaaaagatggcacacgaactgttacagaaacagaacattggcttgctgttgtgccatattgggcggcgtggccttatgaaaccattttgatgccaaaacgccatatcaaacgaatgagcgaattgagcgaagcagaaaaagatgacttagcccttgcgattaaaaagcttacttgtcgttatgataacttatttgaatgtgctttcccttattcaatgggctggcattttgctccgttctttaaagatgggcaagatattgaacattggcaacttcacgcctatttctatccgcctctgttacgttcggcaacggtgcggaaatttatggtcggctatgaaatgttagctgaagcacaacgggatttaaccccagagcaagccgctgaaaaattaagggcggtgagtgaagagatgcattataagcaaagataatggtaggggcgggtcgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccggcgataaaggttacagtcccacccattttgataagatatgnnnnnnnnnnnnnnnnnnnnnnnnnnnnnnnnnnnnnnnnnnnnnnnnncagttgccagcctgcattatttacagcattgactacagtatcaacagttgcaaatcctnnnnnnnnnnnnnacaatttgccatcagtgttaaagtgaaacgtacctggtttagcggcattatcaattttttgtttaaattcatcggttaatttaaccgtaatcgtatcgccgctagcgacggaagtaagaccattttcgccttttacgttgagcgtacctgcccataaaccaacttttggttgttcatcattggaatctccaccaattttcattgtgagcgatttaagctgtgccacgtttactgcgtcagttaattctttacctgccgcmacrttgacgatttggcgtttgattctgtcattacccacagaattacccacagaaactgcaccaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtatttgcgtgttcacccacagcgacagaacctacgccatttgcaacagcttgatagcctaaagatgccgaatgactgcccgctacagaactgctaccgacagccacaccatagtcgccatttgaagcacttttcgcaccgattgctacaccttctatatgggttgcttttgagactggaccgactacaactgatccatttccatctgcgattgattttccaccaattgcaatggcagcatttccttttgccgtggtggtagaaaatcctgctacagtgccatattcagtcgtatttaaatcatcgccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtaagagattgtgccccagttgcactagccaatgcacctattgcaactgtttgtccatttaacgcattggctcctttgcctaaggcgatagattgattgtctttagaaatactcgaatgacctatagcaaggccagaatctccatgtacaacagaatgtgcaccaaccacaacagagccctctttttttgcttctgagttataacctatcgcaatagtagtcctattttcagcttttgagttctggccaataccaatagcaccatacccaaccctactaccttgaccaataccaatagaaccagcgtcacctcctagagaccctagactagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttaattgttatccacacaactttgtgaataccgaattatctgtgggaaagggttatattttttgctaactagatgacgctactgttaagacactgccactttagttaagggaattaataattggaaggaataatactcaaatgctaaatgaggccccacatccacaagtagaacttgcatttggattttgcacaacaaaacgtgagccttccaacccttcaacatagtctatagtagctccaattagatattggagactcattggatcgataactaaagctacatctaaattttcaatggttaaatcgccctcattaagtttatcatcaaaagtaaacccatactgaaacccactacagccgccacctgtaatataaacacgtagacggagctctgggttttcctcgccttcaatcaagaatttaactttttttgcagcagcatctgtaaaaataagaggcactaagatatcactcattatttgtcctaaatcaaaacttgtaaccacctacattatctaacaattatgaattaagggcaatgggatggtatcccatcccttaatttaaaatattccagcaattaaagttagggtttataaataaactctaccccttcatcatcttcttctgtccaaccgtcatcatctaagtcgtcccaatcatcttcggtaatcgggtgttgcattgcttgttgatgatagtcgtcccatttgaatgcgacttcttcttttgctttttcctcttcttcaacacgcggatttgcttcgataaagtccataatatcacgggttaaagcggatacattttgccctgttgcggcagaaatcaagtagtaatcaccttcccaaccgatctcttctacaatcgcttcggctctttctctcgcctcttcttcgccaatggtgtcgattttgttaaacaccagccattgcggtttatctgctaatttttcgctatattgatagagttctgactcaataatagagatattttgtgcaggatcactctcatcaatcggcataatgtcgacaaggtgaatgagtactcggcaacgctctaagtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaccttccgccgcaccttcaatcaatcctggaatatctgccaccacaaagctacgatccgcaccaactcgtgctactcctaaacttggcacaagggttgtgaatgggtaatctgcgactttcggttttgctgctgataccgcacgaataaaggtggattttcctgcgttcggtaaacctaacattcccacatctgcaagtaacatcaattctaactgtaaatcacgtttttcccctggtgtgccgttggttttctgacgtggcgcacgattgaccgatgacttaaagcgagtattccccaaaccgtgatagccaccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccccaaaccgtgatagccaccttttgccaccaacattttcataccgtgtttggttaaatcgccaatcacttcttgggtatcgttgtcaatcgcacgggtgccaacgggtacacgcaaggtgatgtcgttaccacgatgtcctgtacaacccgcactgcgaccattctcgccacgacctgcggcaaagcgtttttcaaaacggtagtcgataagcgtgtttaggttctcatcggcaattaaatagacatcaccaccatcaccaccatcaccgccatcaggaccaccttttggaataaatttctcacggcggaagctgacacagccgttaccgccatcgcctgcttccactcggatcagggcttcgtcaataaatttcatatcttctcctatttcccatacaaactagggaaatgcttattttcttttaactaatttatgtccgaccgccgataaaatcgtgccagacaccacaataaatgcgccgatataactcaataaattcatatcagggcttgcaaaggtatcgggaaatgcccaatgtccaatgcttgaaaaaaccatcgtaaaaatcgggactaaaatcgtgactacacttacttttgatgcgtcccagtgatttaatgcttcggcatatgccccatagccaatcaaggtatttaaacaacagaaaatgaaacaacccaataaaaacggatcaaattcatctatgtttatctggctggcaaatggtgtgagtagcaatgcacagcccgtataaataatcagcaaaatctgctgtgagctaaattttgccaacattattttttgtgcaatcgcataaaccacccaaacaattgctgctcctgcaccgacaagcaacccaaaagcataagtgcctaactggaaaatttcctcaaaacgctcattaaaaaaggcgattaaaccaataatgagcaatagcaagccgatttgctgatgtcgcccaaattgttctttaaaaatcaccacaccacataaaatcatcgtaaacggcgccaattgccacaatacttggctagttgtcggtgaaataaagtttaaactatagctaaacaagaaaaagttcagcgataggcctaccacgcctaacccgattaaccaaagaaaacgtggagtgaaagcggtcagttttggcaatttttttgtaaagcctaaaatgagtaacaaaccgattgctgccacaataaaacgagcccatacgagcgtttgagcattcacaacactcaacactttttgtgctgcaatcggcacagaaccccacatcattgcagtaagcaaggctaatgaaaatccaagtaatggacgttgtagtttcatattaaatccgtttatgtcgataaaaaagtttatgcccagccgctgaaagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgctccacataccacgacaactgcccctaaatgcgttaagtgattaaaatcaggttcagcaaaatgttcagggcttaaataaaatgccaactgcgaaaataaaattgtacagatcgggataagtggcatcattacgctcactttagtcacctcccaacgatttaatgcttcggcataactaccataagcgatcaccgtatttaaacagcaaaagatcaggcacgctagtgcaaagccactgagatcattgacctgtgaaagatccgctaaaggcgtgaaaacaaggctacaaccacaataaataaacagcaaaatttgctgagaattaaaccgatctaacatcatcttttgagcaatgctgtaacagatccaaatcagactagcactgactgcacatatcattccccaagcatattcattcatctgagcaagatcgtcaaaacgatcattaaaaaataaccccaagccaatcagcacgataacaaagccgattttctgatgtaaaccgaagctctctttaaacaaatagacaccgataaacgccataatcaaagatgaaaaagggctaatcacttggctggctgcaggtggaatatgatttaacgctaaattaaacaaataaaaattgcaggataaaccgaataccccaagcaatagcagataataatggcggcgagtgaaagcggtcactttcggcaatttttttgcaaagaacaaaatcaaaaacaaccctatcattgcagtaataaaccgaaaccagacgatcgtttgagcgtccataaatttcaaaatttgctgcaaggctatcggcaacataccccacatcattacggcagttagagcaaagagaaaaccgagtaaaggttgtgattttgacataaatttttttgtttcaatggtaataaaaaaccccgctaattgattagcggggcattttaatcttattcttttgaagattattcagcaataatgcttacatatttgcgatttttctcgcctttcacttcaaattttactttaccgtcagcagttgcgaataaagtgtggtctttacccatacctacattgctacctgcgtggaattttgtaccacgctgacgaacgatgatgctacctgctaatacagattcgccaccgaaacgtttaacaccaaggcgtttagcttcagagtcacgaccgttacgagttgaaccaccagcttttttagttgccatctacttgatctcctctgaaattatgcttgaatcccagtgattttcacttctgtgaaccactgacgatgaccttgttgtttacggctgtgtttacgacgacggaatttaacgatgcgaactttttcgccacgaccgtgtgcaaccacttctgccactactttaccgccagcaacaactggggtaccgattttaacatcttcaccattaacgaccattaacactgagtcgaactcaactttttcacctgtcgctacttcaagtttttctaaacgaacaacttgaccttcgctcactcggtgttgtttgccgccactttggaaaactgcgtacatatttactccgctaatatgtgcctatcgctatgcgtttggcactctcaaattcatataaaataggtggacaattctacgcaaaaactcaaatgagagcaagcaagaaattgagaaaaatttgaaattcttcaaaaacaaacaaaaaagatcgtttagagaaggatctttaaacgatctttttaagctcactcaacacattagagctgagcccacttccaatttccattcaccgctgtacctaatacctcaaactgatgattaaacgcagttaaattggcaattttgccagcttcaatggatcctaacttatcttcaacatgaatagcacgagctggatataatgtacacatacggatcacttcatctaacggaagatcagtatgttgcatcatattacggatcgactcgatcattgtaatcgccgcaccgccaagactgccacactcatcgacacatttaccgtctttgtaccaaactttcttacctacaaagataaaatattccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagataaaatattccatatcagttgtaccagctggggcaaccgcatcggttacaatcaccaatttatcgcctttcactttcttcgcaatacgcacattactccaatcaacgtgcaaaccatcgacaatgataccagcgtaaatatcgctatccaacactgcaccaactactccaccatcgcgcccagagctgatcggcgacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcaaagccaatgccttgctcaatacgtcgttttgcttcggcaaaggtcgcatttgagtgtccgatagacacaataatcccagcttcaacaaatttctgaatatgatctgccgttgggttgtctgctgcgagtgttaatttcgtaatgacatcaccgtttttgcaaagaaaatccaacatctcaccgcttatttcacggatatattcagggcgatgaaccccttttttcgccacacttaaataaggtccttctaaatgcaaaccgagtgcttggtttttatatttagccaaatagtcacgcattacttgcaccgcttgtttcattccttcgtcaggcgaagtaataaaggttggcaaataacttgttgtacctgatttcagattggtttcttgcataatttcaagggttttaacactaatatcttcattaaatgttacaccgccacaaccgtttaactgcagatcaataaaaccagcagaaagatttgcgccctctaaatcaatctgatgaaccccatctgcaacttgactttgatgaaccacagcctcaatctgctcaccattgacgatcacagcatgctgatatagcacatcacttcccgtataaatcacacaatttgttagtgcataacgccccatcttttcctcctagcgagctatattttgctctaattgcttgaaatacttaacggttttaactttcaattcttgtgttgcaggttcatcacaaaccacgactgcacgacgatgtaattgtaacgcactgatcgtccacaaatgatttaccgccccctcaacacaggcttgcaaggcaagggctttattataacccgtgactaaaattaatacttcctctgcgtccatcaaagtaccaacccccactgttaaagcaaattttggtactttattgacatcattatcaaagaaacgagagtttgcaatcaacgtatcttcggtcaaagtcttgatgcgagtgcgagaacttaacgatgaagcaggttcattaaaagcaatatgcccatcaacacccaccccccccataaagagatgaattttgccataagagcgaatttttgcttcataacgttcacattcagcatctacatcttccgccattccatttaggatattcacattttctactggaatatcaatatggttaaagaagttatggaacataaaatagtggtaactctctttgtgctctggcggtaagccaacgtactcgtccatattaaaggtgacaacgtgtttaaaactcacttcacctgcttgatacagcttaattaattctttataagtttgaagtggcgttccccctgttggcaagccaagtacaaaaggcttttctgcagtaggttggaaagcattgattttatctacaatataacgagcagcccaacggctcacttgttcagcacaatccaaaggcactaaacgcataaatcctcctagaaaaagtcaaatttgaaataaaacttcattgacgatcattataaagaaagatttgcttcatttgtagaaaatttacttaaaatttgaacaagatcataatttatcatgaaaaagcccttgctcagatacaatcaatatttttaagttcctacaaagtattccagtaatactccaataggatgaatagaatattgcgggttattcatccaaaagtaattatctttattctgaaatagtaaactaaaaccaagctagataatctcaagaagattgggactatagttcataaaagcataacgatagtgtagtttatgcctgtagtaccagaatatatatttggatcttaaactactccgtttattccaatatatctcatattctataacttatgacttcacagccccatcataaatatgttctgcgtcacctgtcatataaagcggtgaacctacaccttgccattcgatatgcaaggttccacccggaagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacttgaacacggctatccaataagccttgcataatcccaaccgcaacagccccacaagcaccgctaccacaggcttgtgtttcgcctgtaccacgctcaaacactcttagtttgatatgatttcgattgatgacttgcataaaaccgatattggcacgctctgggaaacgttcgtggcgttcaagtaaagcccccaattcattgacattggcggtttgaatattttccacctgtaacacacagtgcggattgcccatcgaaaccacaccacataacaccgtttgaatatccgtgcgtaaaatataatttttttcaaacttatttgcggtaaaaggaatttgtgcaggttcccaaattggttcccccatatttacgcgaacttgaccatcgtcttgtaagcttaaaaccatcttcccttttgcggtactcacaccaatgtcctgcttgttggttaagccttttaaggtaacaaaacgagcgaaacatcttgctccatttccacactgagagacttcactgccatcagcattaaaaatacggtagtggaaatctagttctggatcatagggtggttcgaccagtagtagctgatcaaaacctacaccacgatggcgatctgcccatttacgaatgagatcttccgttaaatagacattctgcgttactccatcaatcaccataaagtcattgccaagtccgtgcatttttgaaaactgcataatttttcctagtattagaattttttattgatctagattataacgattataaatttttatgctatattgcacgccttttgtataaagggcgaacaatcgccaattcttcctcagtatgagggctttttcgttaaattacaatggagcaaattatgtctgctatgtttcttattgaatttgccgttgtattactctgtattttaatcggtgctcgccttggcggtatcggtttaggggtaatgggcggtttaggtttggcaatcctctcttttggatttggcttaaaacctgcaggtcttccaatcgacgttatgtttatgattatggctgtcgtttctgcagcggctgcaatgactatatgatcaaaatcgcaacaaacattttacgtcgtaatccaaaacacatcactttcatcgcaccagcggtaacttggacatttactttcttagcaggtacaggtcacgttgcttactctgtattacctgtgattgcagaggttagccgtcataacggtatccgtcctgaacgtccactttcaatggctgttattgcctcacaatttgctattgtagcaagcccgatttctgccgcggtagtgnnnnnncattttattagtaactattccaggcacgattttaggtcttttctgtgcgtgtttattcgtaaataaaatgggtaaagagttaaaagacgaccctaattatcaacgtttattacaagatcctgagtatgtggcaagaaatcacgcagatacaaacccagcagagatccaaattagcccaacggctaaaacctccgtaagtttattcttatttggtgcattacttgttgtgtattcgacggcaaagcaatgggaatggctcatactatcgaaatcgtgatgctgactgtggctgcattaattatgcttatctgcaaaccaaatggtaacgcgattacacaaggttctgtattccacgcaggtatgcgtgcggttattgcaatcttcggtattgcttggatgggcgatactttaatggacgctcatatgaccgaagttaaagatatggtgaaaggcttagttgaaactgcaccgtgggcatttgcgttcgcattgttcgtactttctgtattagtaaacagccaaggtgcaacagtagcaaccctattcccgttaggtgtagcgttaggtatccctgcaccaatcttaatcggggtattcgttgcagtaaacggttacttctttgttcctaactacggtccaatcattgcgtctattgactttgacacgactggaacaactcaaattggtaaattcattttcaaccacagctttatgatcccaggcttattaagcatggcatttagcttagtgtttggcttagtattagcgaatgttttactctagtagaacttcaatttgatctacactaaaagctagactttttaatagaagggctgagtgctatatttaatagtgctgtgtccttttatccttatttgaagatacatatcagacatttctggtttaatctcaatacctttatctgtctaagcgttacttataaaaatggctcatagaataaaaatagcttaaagtcttttattataagactttaagctatatgaaaaggcatttctctttaaaaagtattgttagctaataatttctagtccttttttaatgttacacaccgatttcccactaaaaaagcaataagtccaattaccaatgctggcacgatggcgtgaaagctaaatattttgatagataggcttgtcattaacacataacttgataaacctgcaatcattgaacaaatagcccctgttgcattcgcttttttccagaatagtcccaatacaattacccataagaatgtcgcttctaaccctcccagagagagtaagtttaaccaaatgagcatttcaggtgggttaatggctgcgatcaccaataaaacgctgatcactagggtagtgattgtcgagaaacgtttaattttttcttcattttcaaccgcttgtggcttaattgcgagatagagatctttaatcagggttgaagaagattgaataagcattgagtcgattgaggacataatggctgccattggtgcagctaagaaaatgcctgcaacaacaggcggaagtacttgtaacatcaaggttgggataacttgatcggcaacttttagatcgggaatcaccgctcgtcccaacgcacctgctaaatgcataccaaacatcaacacagcaacaacgacagtgccaataatcaaagctcgatgtaaagccttgctatctttatatgccatactccgcactgcaaaatgtggcaatccaattagaccaaagcagaccaatacccagaaagatgtcataaaggtgaagtctagtggacgttcatcaataccataaggtgcagtcagttgagggttgatattttctaactgggtaattgcagcatcaacgcctcccgttgcataaattacaccgccaagcagtagtaatgtgcctacaaccatcactaagccttgaatcgtatcggtcaaaacgacggcacgaaagcccccgataaaggtataaataccaacagtgaccgcaaaaataatgatcgcggtgccgtaggaaatgccaagcgtagtttcaagcaaacgtccagcaccgataaactgtacggtcatcattgcaaagaaagagagcaatagagcaaagctagcaatccacaccacaaagcgattttgataacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttggagagccaaaatggcaattcgtttgccaacaatccctaatgagagaaaaacggctggcacttgaatcattgccaataatacccagcccaagccatatttgtatgccgcacctggcccgccaataaagctacttgccccaacataagtggctgctgtcgtcattgccaaaacaaaaccagacattgagcgtccaccgacgtaatattctgataaaaagctaccgcttgtacgttggcgataggcataataggctacgccaaatacgaaaatgagataggcgattaaaggtaacaacaactcaagattcatcttttccccctaaatcaatatcttgataaatccattttactactgcgctgatcaataacgttaatacgattggaagatagacacaacttaattcaaaccagaggggaaagcctaaaaaacctcgccctgcaggtgaaaaataagcaaaaccgacccaacccataacataaaatagcgtcagatataatgcccaacgcacttcacgatctatttgtttagacaccttcatagtcctcctattttttagctaaaataaaacctcgcagttgagaggtttgaaatcatttaatattgccacttatctggatctattcctagctctcgcattttcagttttgcttcctcaggaatttcattgctacgttctttcattaaatcatcgtcggttggcaatggctgacctgtaaaggcgtgtaaaaacgcttcacaaagcaattcactgtttgtggcgtggcgtaaattacgaatttgacggcgagtgcgttcgttagtcaaaatttccaatactttaatcggaatagataccgtaattttctttacttgttcactttttttaccgtgttcagcataagggctgatatattcaccgttccaatctgccattgtctgttcctaaatataaaagttggcgtgcattttaatcaaaactttatgttatcgcaatcttgaataatagcgcctgttcagatgtaaggcattattccccatctaaaaataatgtcattttccttgacggctcaattctaaatctgtaccattcgcccgtttttttcactttgaggatacacattttggacagtcacagtcgatacttatcagttttttaacccacctcgtccaaaacctctttgccgatgagcgtcggtaattcttatcagtatcttatattttgttcctttttgttcatcgcctcatatccaatttttaggagtatgaaatgatcagagctttttcgttaaataacgatcgcctagtcagtgtagatgaaaatattcaaaatcaatttaatgaagctatttggatcgatttgattgatcctacagatgaagaacgtggtgttttagaaacgcgattagatcagacccttgcggaagaacacgaattggaagacttagaggcttctgcacgtttttttgaagatgaagatggcttacatttacactcattcttctactgcttagatgatgacgactatgccgatattgctactgttggttttactattcgggacggacgtttatttacattgcgtgaacgggatctacccgctttccgtttgtatcgaatgcgctcccgtcgtgcaaaattgatagatggcaatgcttacgagcttctacttgacctatttgaaactaagattgagcagttggcagatgttattgagaatatctatgcagatttagaaaaattaagccgtgtggttctcagtactcatgagggtgaaaataaaggcgagcataactttgatgatgcccttgctgaattaacggaacttgaagatgccagttctaaagttcgtctatgtttgatggatactcagcgagcattgagtttcttattgcgtaaaacccgtttgccaaataatcagcttgaacaagctcgtgatattatgcgggatattgaatcacttcaaccgcataacgaatcgcttttccaaaaggtaaactttttaatgcaagcagcaatgggttttatcaatattgagcagaaccgtattatgaaatttttctcggtagtgtcagtgatgttccttcctgctacattggttgcttctacctacggaatgaactttgaatttatgccagaattaaaatttcaatatggttatccgatggctatcggtttgatgatttgtgcggctgcgacaccatatctttattttaaacgcaaagggtggctatagatatttaattttgtcctttaagcctaaaaaagtgatgtttgctacattaattagttcaacttcaatgattgtcaccagataatagccacgcataacgtggctattttgcttttaacgtattttctcaatcaactccgccacaaacgccaagcgatcttctggtcgttccattggcttggtaaagcggaatttcaacgggccgtcaaatttatagacatttttatccgcttggatcagttttaagaacttcatcggatcaggcgttgctgttggtttgaactcaagataaccgccgttgatccctgcatcgacttttttcaactgtaacccttttgctaaatggcgtaactgagtaatttggaacagatttttcgtggcttccggcagtaaaccgaagcggtcaatcagctcaattttcagatcttttaaggcttcatcactctctgcgctagcaatccgtttatagaacgacaaacgcatattcacatcaggcagataatcatcaggcagtaacgcaggcacgcgtaattcaatatccacttgctgttgggtaatttcgtctaaagtcggttcacgcccttcttgcaaggctttgaccgcattttcaagcagttccatatagagtgagaaacctaagctctcaatctgtccgctctgttcgctccccagcagttcacccgctccacgaatttcaagatcgtgggtcgccagcacaaagcctgctccaaggttatcgatagtactcatcgcttctaatcgttgttgagcatctttggttagcgtttttggcggtggggttagcatataggcataggcttggtggtgcgaacgtccgacacgcccacgcagttggtgtagctgtgccaagccaaatttatccgctcgctcaataataatggtattggcggtcggcacgtcaatccctgtttcaataatggttgagcaaaccaacagattaaagcgttgatggtagaaatcggacattacccgttccaactcacgctctcgcatctgcccgtgtccgatcacaatacgagcttctggtacgagttcggcaagctgttgagcagtattttcaatggtcgctacatcgttatgcagataataaacttgtccgccccgcagaatttcacgcaaaatcgcttctttgattaccgtatcatcgctttgtcgcacaaaggttttgatcgacaaacggcgagccggcggactggcgataatcgatagatctcgcattccgttcaacgccatattgagcgttcttggaattggcgttgctgtgagggtgagaatatcaatgttggctcgtagttgcttaattcgctctttttgacgcacgccgaaacggtgttcttcgtcaatcaccagtaagccaagatccttgaactgcacatcttcttgcaataatttatgtgtgccgaccaaaatatcgaccttgccgtccgccacttttgccaaaatctctttctgcgctttggcggttttgaaacgggaaagcacttcgacattgatcggataattagcaaaacgatctttaaaattctcaaaatgttgctgtgccaacaaggtagtcggagcaaggatcgccacttgtttatggttcattaccgccaagaaggtcgctcgcattgccacttcggttttaccaaagccgacatcgccacacacaaggcgatccattgctttcggcaagcacatatcgctaatcaccgcattgatcgccgttttctgatcttcggtttcttcaaacgggaaagtgttgctaaattgcacgaacgcatcacgatcgtactcgaacgcaaagcctttttgtgcttcacgtttcgcatagacatcaagcaactccgccgccacatcacgaattttctccgccgctttttgacgagttttcgcccacgcttccgatcccagtttatgtaacggggcattttcgtccgttccgccgatataacggctaattaaatggagcgaagccaccggcacataaagtttggcatcgttggcataatgcaacacaaggtattccgccttaataccgccagcatcaagggtggttaaaccgccataacgccccacgccgttttccaaatgcaccactgcttgcccgattttcagctcggcaaggttgcgaattaaggtgtcaggattaacggttttacggcttttctcttgtcggcgactttgctgtactttctcgcctaacagatccgtttcgcaaattatcgccagtttttgaccgcttgtttcaataataaacccttgatcaagcggtgagattaacaaagaaatttgcgaattaatctcagccagttgcttcacttgctttggcttgatatttagcggtgcaagtagctcaagcaaggtttcccgtctgccttccgtttccaccgaaaagagaatttgccccttgaatgtttgttgaaactgtaaaaaagaggcaaaaggttctttttggttggattgcaccgcaatgtcaggcaacggctcaaggttggcgttctgcttagccgccgaactgcggactttctctttggttaaagttaaacgtggatagccttttagctgttggttaatctgatcgatattgaaccaaagctgttcaggtggaagtagcggtcgcatcggatcgacacggcgactttcatagcgtcttgcggtatcttgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggctttttgctgaatatcggcaaaggtaataaacaatgtctgttcaggcagatagtcaaacaagctcgccatttgctcaaaaaagagcggttgccagtattcaatccctgcattcaaaatgcctttgctcacctgctgataaatatgctcaggttcacggcggatttcaccaaattgttcacggaatttgccacgaaaatactcgatcccgttgctatctgtcgggaactcgtgggctggcaataaattgattgcatcaatctgctcaatggtacgttgattatccacatcaaaggtacggatcgtgtcaatttcatcatcaaaaaagtccaaacgataaggcgaattcgcccccatcggatagagatcgagcaacgccccacgcactgcatattcgccatattccagcacctgttccaccgctcgatagccggcattttccagctgtaaacgcaatttctcaatcgaaaaacggtcgccttttttaatcaacagtacattgtttgccaaataactcggtgggcagactttttgtaataaggtattgattggcaacagaaaaatctgcttctgcccttgttgtaactgaaataacgcagataaacgggcggaaataatgtcttgatgaggcgaaaaattgtcgtaaggcaaagtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattgtcgtaaggcaaagtttcccagtcaggaaaaagctgaacagacagtttcgtgaagctcggcaagcttttttccaaccgcaacgctgtgcgagtatcaggtgtcaccaccaccgtcaagccttgaaactgctggctagcctgtacaatcgcaagggtatccgaatgcccgattaaattgcctaaagtttgatgatcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaaagtttgatgatcttgatgtgtgctgtccgctttcggcagacgaaattgaagttcaaatgacatacaagcggtttgatttatccgaaatattgcaaatgtaagaattgtactcgctatgggggcgagttgcaaaagattgaagggaataggagcgcttgtattatgtgagtgaatcttaaaatgcttaccaataatgatgatctctgtatcatagagaataattaaagcacgatatgaataatagttctttatataaaaaatcaacattgtaaaatatattcataacataggattagctacatattcagatagccgtttatagatattcaaatgttcttagaaaaactactactcactcgtcgttttatttcgacccttgcttatttttcaatgcaaacggtcttttttatctacctgcaacaaaaaggcttatctaacgctcagatcgcattttcgttgtcggtactgtttttttgtagccaagcccttgcaatttttgcaggggtgctaggcgaccgctatggtttggctaaaatgatgttagtcggctgtatgctcgatgtgatcgcctatgttttcttcttgtctgcggaaagctacacggtgctattaatggcgacaatgtgctttggtatgggaagttgtctgtttgcaactaatgcaagggcgtgcttacttgcattggctggcgatgaatatgcggcgaaaacccgtttacaaggcaaattcttacgggtcaccagtatgtcgtcgatggcagctccgttgctcgctattccctttatcaaatatgaacagatcaatgcgttaatctggtgctgttttctcttggaagcagtgttatttgtgtttatggcaaagccgttctaccaaatggaaaatgtgaacaatttagtgaaatttcgttgggggcaaattcgggaaatcattaccaaagagtttatttttgttcacttaatgctgtttgtaccgttaagtgtcgcaatgtcgttttttgtgattttcccttatctgtttgacaataaactcaatgccccggagcagatcccgattgcgttatttatcaatgggttgatgaccgttgccctacaatcgtatttctccaagcatatcaatttaacccgtaagcaacttattttcgttagcccgattttagccgtcggtatggttgtgccttggtttatcaccttacattatgcttcgttggtttctgcctatctctatctggtgatttttaccttgcttgaagtgtatgcattaacggcaatggcgaatttattagtgaaatttgataacggtaaaaatcgtggatttatcttcggatcgtcccgcttgatccagtcgattttgacgatgatggtgatgaatttaattcctgtgttgtttttggtataaaaataagcggtaagataatgtatttcgtcttcatcttaccgcttatagggaatgttattttaaaagatactctcttaacttcgcaaaatctgccgccattgtatccgacaacagttccattttgttatgtttgtctaacgcttcaggcaacggcagttcaatatctaaaatacgttctacgctctctttaaatttcgcagggtgtgcggtgcaaaggaaaatacctgtttcgcctacttgtagctgatctttcaatacttggtaagcaatcgcaccgtgtggctcacataaatagccttccgcatattgtgcttttaatgcttcttcggtttctgcatcatttaaggcatctgaacctaaattcgccaagctccaaccattacgtttaaacagctcttcaacacgtggccagttgttcggacggctaacatccattgcatttgataatgtcgcaaccgttgcattcggttcccatttgcccgatttaagataacgtggcacagtgtcgttcgcattggttgaagcgataaaacgcttaatcggtaagcctaaggttttggcaattaagcctgcagttaagttaccaaagttaccgcttggtacagaaaccaccacatcgctacgtttctctttcggcaattgagccaccgcttcaaagtagtaacaaacttgagcgagtaaacgactgatattgatagagtttgctgagtttaagccgatagcttgacgaagttccgcatcatcaaaggcttgtttaactaacgcttggcaagcgtcaaagtcagattcaatcgccacggtacgaatgttaccgcctaaggtacagaataatttttcttgtaatggactgattttacctttcggataaagaataaccacattgatattttctaaaccgtagaaagcgtgagccaccgccgcacctgtgtcgcctgatgtcgctgttaaaatggtaattttgccatcaccacgcaccgcacttaatgcttgtgccataaagcgaccgccaaagtctttaaaagcgagggttggtccgtggaataactctaacgcataaatatcatcattcactttcgctaacggagcagggaaggtaaaggcattttttaccattgcatttaaggtttcttgtggtaattcatcgccaatcaatgccgataaaatcttttggctacgctcaaccagcggtaatgctaataaagcgtcaatgtcgtcaaatttaggtaacacttcagggaaaaataagccctgatctttgcctaacccttggcgaacgccttgggcaaaattcacttgttcttcagggtgtttgatgttgtataggttcattaatgttgtccttnnnnnnnnnnnnnnnnnnnnnnnntgattgtatctgttcacttccgttagtcaatcacaagcggtgagatttgcgagattttttgcaaaannnnnnnnnnnnnnnnnnnnnnnnnnnnnnnnnnnnnnnnnnnnnnnnnnnnnnnnnnnnnnnnnnnnnnnnnnnaaatgagatttacatcacaaaatttacaaaatacatttgcaatgtaaannnnnnnnnnnnnnnnnnnnnnnnnnnnnnnaaaatgtttaaaagcgaatttttcaaaattataaaagttacaaaggagtttgtatgttttcttttttaaaagcatctgcacctgcaccgagaattgaaagttctcgtacagacgcagaatatcgcaaattacgttggcaagtatttgctggtgtatttattggctatgcagcttactatttgattcgtaagaacttttctttagccattccttatttaatcgacgaatatggatttagcaaagcagatcttggtacggtcgcagtggcattatcccttgcttatggatttagtaaattcattatgggaaatgtttcagatcgctcaaacccaaaatatttcatcactattggtttattaggttctgccatcatcagcttgatttttggtttagtacctggtgtactttcttcaattccattaatgatcttacttgcagctttaaatggctggttccaaggaatgggctatccaccaggtgcaaaaacaatgaccaactggttctctcgttctgaacgtggagcttggtggagttggtggaacgtgtcacacaacttaggtggtggtttgattggtccattggcgattttggggttatctatcttcggtgtatggcaatccttgttctaccttccagcattgattgcgattgtacttgcctttgtggtgctttacttaatgcgtgatacacctgaatcacaaggtttaccgcctgttgatgagtggaaaggcgagaaagtattagaaaaagtggaatcagcacataccctttcttcaaaagatattttctacaaatatatcattaacaataaattcttatgggcaattgcgattgcgaacgtgtttgtttacttcattcgctatgggattattgactgggcgccaacctacctaaaagaagttaaacactttaccgtagacaaacaaagttgggcatacttcctttatgaatacgcaggtatctttggtatgctcgcaagcggttacttaagtgataaagtattcaaaggtcaccgtgcaccgccaatgttattattcctcgttggtgtattaattgctattgtagtttactggaaaaacccagctggcaacccattagttgataacatctgcttagtggcgattggtttcttaatctacggtccagtaatgatgatcggtttacaagcggcagatttagtgccacgcgttgcaacaggtacagcaacaggtttaactggtttattcggttacttacttggttctgcaagcgcaggttgggtaatgggtaaattagtggacgtttacggttgggacggtggtttcttttgccaaaatccgaccgcttgtacttgtaatttgccaatctggctctatattacagcagtcattattttaatgaatgtaggggcgaggtttatcctcgcccgaatttatataaacacattaacgggggatcccctctacacataaggaaaaattatgtctttaaatttagaacaagtgaaattagaaagcgttgaagcaaaaggtggttatggtatcggtttacaaatcggtcagcaattattaggcagtggtttagatgttgaaccagaagcggtggtaaaagggatttttgatgtgttaaatcaaaacccacctgcattagatttgaatgaagtaaccaaagcgttacaagagttatctcaacgtgccgaagcagaacaagcaaaagcttttgaagcgttagcggcagagggtaaagcgttcttagaagagaataaaaaacacccagctgtgaaagaaacagaaagtggtttacagtatgaagtgttagtggaaggtacaggtaaagtgcctgcgaaaacagataaagtacgtgttcactatacgggttcattaatcgacggtacggtattcgacagctcagtgaaacgtggtacaccagcagagttcccagtcaccggcgtgattgcaggttgggttgaagcattacagatgatgcctgtgggttcaaaatggcgtttaaccattccacataaccttgcttacggtgagcgtggtgcaggtgcgtcaattccgccatttagcacgttaatttttgaagtggaattattagatattgtttaagtgataaaggacgtcatgctggcgtcctttatcattcaatgaatcgtcttatttcaacactgccaacgccgctgcatagtcaggctcttgtttgatttcagggactaattcactgtgtagcactttattgttttcatctaatacaatcactgcacgagcagttaaacctgctaatgggcctgttgcaatatctacgcctaccgcttgatggaaggctttgttgcggaatgttgaaagtgtttgggcatttgcaattccctcagcaccacagaaacgtgcttgggcgaaaggaagatcagcagaaatgcaaagtaccactgtgtttgcgagttcggcggcttctttattgaaaacacgcacggaagttgcacaaatacctgtatcaatacttgggaagatgttaagaactttgcgttttcctgcgaagtcggaaagtgatacgttttctaagccattgctcactaatgtaaaatctgccacgaaactgtccgcttgtggaaattgtcctgcaacttcaattgggttgcctgctaatgtaatttgggtcataactgctccttaatggttgaaaaaacctgttcaatataacgatttcttgtgtaaattgaaatgaattttaacgatagtttttggttatctttttggcaaatagcaatatctcggctatacttccgttggtattttttttcaaaggtttttgactatgttaaaactatttcgcattgttgcagttgcttcccttgcaatgttaatcagtgttattggtactctttatgcgttaattcgtttacgtcaccctgatagtgttagcgttgtggctaaaatgtttggttctcttcatcaattgcttggcgttaaattaattacacgaaatagagctgcgtttgatcaacctgctatctatatcggtaatcatcaaaataattatgatatggtgacgattgcggcgatggtgcctcctcgtacggtaagcattggtaagcgtagccttatttggatacctttttttggtttgatttattgggcgacggggaatatttttattcatcgtgaaaaacgtagtagtgccatcaatacgatgaataaagtaggtgaaattattcgtgataaacagctctcagtatggatgttccctgaaggttcgcgtagtcgtggacgtgggttgcttccttttaaaacgggagcatttcatacggcgattgcagctggtgtgcctattgtgccgattgtctgttcaacgactcataataaaattgacttaaatcgtaaggataatggcgtggtgatttgtgagcaattagaaccgattgatacgtcgggttatgaccgtgaaaatctcaaagagctgattgaaaaatgtcaccaaattatgcaggctaaaatagaacaattagatcaagaagtcgcacaattagaacgtaaataatatgaaactttctcgccgtcaatttttacaacgctctacattagctggggtagctacttttgcccctacgtcgttatgggcgaaaaatcgtcctagtttaaccattccgccgatgattgaagtggggcgtggtcgtcctgttcgattggattttcgtcctgctcaaacgcaatttaataaagggaaactggttgatgtttggggtgtaaatgggcgttatcttgcccccactgtacgagtgaagtcaggtgattttgtcaagctgacctatactaacaacctgccacaagcattatcgatcaatatccaagggctacaagctccaacggaaatggtcggttctattcaccgtgctatagacaaaaacagcagttggtcgccgattttatcggttaatcaatccgcttgtacggcttggtatcacgcagacacaatgttaaattccgctttccaagtttatcgtggtttggcaggtttgtggatcattgaagataatgaaagtagaaaagcgtcactgcctaataaatatggggttaatgatattccgctgattttgcaagatcagttgattaacagtgatggcgttcaagtaattgacactcaaactaatcaattttttggcaaacgcctttttgttaatgggcaagaaagcccttattttgatgtacctcgtggctgggttcgtttgcggattgcgaatgcttccctctctcgtcattatgatttacgtttagacaatggcaaaccgctctatttaattgcaacggggattggttttttagcggatatggttgaaatggaacatatttcccttgctccatcggaacgaattgaagttttagtggacttaaatgagggagataaggtttcattaatcactggcaagaagcgagatttttttgatgaaattgggaaattattcaaagataacaatgagttaaatgataatgtggtgttagagtttcgcccagaggggttgccttcagcgttaaatgtgacaccaaaacttcccccatttaatgtggaagagtttaacttaaaaattacccaagaacgtaaaatcaatctccgcccacaagaccgtttaatcaatcagcaacgatttgatcctaagcggatcgattttacggtaaaaaaaggaacagtggaacgttggtatttgaccacaacggaagcggttggttttaccttacagggtgccaaatttatggtggaaacgagaaatcgtcaggctgtgcctcataaacagttggcttggcgagattgtgtatggttagaaccaacccaagaaactacattgttagttaagtttgagcatacagcctctgagcaacagccattcaccttcggggtatccgatttaatgttacgagatcgtggctgtatggggcaatttgttgttgcggaatagcattaagcggtcggatcagcgagaaaacttgcaaaaaaatgtggaaatcttaccgcttatgtcacattcactgataaaatacagcggtttttatttctgccaaaacagataggaaaaattatgacaacagaatacttagattttgaattaccgattgcagagcttgaagcaaaaattgaagcgttgcgttccgcagtaggtaatgacaacaaaatcaatcttgatgatgaaattgcacgtttacagaaaaaaagtgaagaactcaccaagaaaacgttctcagatttagatgcgtggcaaatttctcgtatggctcgccacccaagtcgcccttataccttagattatattgagcgtatttttaccgaatttgatgaactcgctggtgaccgtgcttttgccgatgataaagcgattgttggtggtattgctcgcttagatggtcgtccagtgatggtaattgggcatcaaaaagggcgtaccgtgaaagaaaaagtgaaacgcaatttcggtatgccagcaccagaaggctaccgtaaagcccttcgtttaatgcagatggcagaacgtttcaatatgccgatcatcaccttcattgatacgccaggggcatatccaggcattggtgcggaagagcgtgggcagtcagaagcgattgcacgcaacttgcgtgaaatgtccaccttaaaagtacctgttatctgtacggttatcggcgaaggcggttcaggcggtgccttagcgatcggcgtgggcgataaagtgaatatgttgcaatacagcacttattcagtgatttcccctgaaggttgtgcctctatcttatggaagagtgctgaaaaagcctcaaccgctgcggaagtgatgggtttaaccgcaccacgtttaaaagaacttgagttaattgataatatcgtaccagagccattaggcggagctcatcgtaactttgatgagatggcagcaaatttgaaacaacgtttacttgaggatttagcagacttggatccgttaaatgcagaagcattgcttgatcgccgttatcagcggttgatgggttatgggtatgtgtagagaattttaggaggaagtgaaaaattttgtgatcttgctccaatttttgaaaaaaaagttgaattatttcttcgcctttatttcgtatttagagtattataatcgttgtcaaataataagaaaaaattcctcaatatcgtcgagtttatgtggcattatttaatccgtaatgccacattttttattttgtctactatgccttttattttcactgatgccgcttagaatggggtttgaatattcttaaactcatttgtcttatgttttgtgtagtggctaggttttctgggatgcttatataatcacctcatacttctgtataatattaagaatagctatctgattgaggaaggacagtttaatattttttagtggagactattagccctgtatgcttatagcttttgaaaaatattaaaaatgttattttcatcttccttcgttttttaaaatgtctatgtgcgtaaggagggatattgaaaggggaatgtaagaaaatttatcaaaccttgaatggtccccctaccgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaacgataagcaaaaaggataaaaaggctttggggctttgtgtatcaagggttttgcgaaaggttgcgataggctaagaaaggttatttggtcccccctaccggacttgaaccagtgaccaagcgattatgagtcgcctgctctgaccgactgagctaaggggggaatctcaaaattacggtgaattatagaaattatttgggcaaaaatctagttatcttgttttatcagatgaaaaaaaggtcaattctatctaaataactagtatctacttgaccttatagataatataaatgggtatattaatctcttccccaccgttagactagttcagcccttttaattgcacttgaatatatgtgaatcgtttaataacttgccattcgatatagctaacttggttcgtcagtcgggagaatagttcaaacttgggagtcattgttaaatcataagcaataatttcatcattaaataaaaccctgaattagcgataggtgaggtttatcctctatacgttaatcgggctgcttagtctaactgttaggcgctgaacagccaccaatctcttatcaatccaaactttttgttgttttatatttcatttggttatttgcaagcggtctaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgcaagcggtctaatttgcccttaaatttgcaagcaatcaatcttacctatcaaaaggaacttattatgtttaaaaaattatcaatcgttgcattatctttagcggcagttttcacttctacagcagcattggcaaaagagtctttattagatcgtatcaacaacaaaggcactattactgtgggtacggaaggaacttatgcacctttcacttaccacgatgcaagcggtaaattaacgggctacgatgtggaagttactcgtgcagtagctgaaaaattaggcgtaaaagttgattttaaagaaactcaatgggacgcaatgttagcaggtttaaaaggtgagcgttttgatattgtggcaaaccaagtaggcttaacaaccccagaacgtcaggcaacctttgataagtctgcagaatatagctggtctggtgcgatgttattagctcgtaatgatgaaacccgtgtaagcaaagcagaagatgtgaaaggcttaaaagcagctcagaccttaagctctaactatggcgaactggcacagaaaaatggggctgaacttgttgcggttgatggtatggctcaggcgttattattaattcaacaaaaacgtgcagatgtgaccttcaatgactcgcttgcattgttagattacttgaagaaaaatccaaattcaggcttaaaaccagtttggcaatctgcggataaagtgggagctggttttattgtgaacaaaggcaacaccgaagcccttgcaaaaatcagtcaggcagttgaagaattgaaaaaagacggtacacttaagagattaggtgagcaattctttggtaaagacatcagtgttaaataatttattactctctctaccatttatgaccgaagctcgtgttgagctggtcataaatggtttctggccgatggtacaagcggcctttttagtttctatccctttggcaattgcttcctttattattggtatggcgattgccgttggggtagcgttagttcgtgttactcccgtcaatagcgcgttccatcgtctgttactctggttcgtcaaaggctatatctcgatcattcgtggtacgccaatgttggtgcaaatctgtattgtcttctacggattacctgcgattggcatttttattgatccgatcccagcggcaattattggtttttcgatcaatatcggggcttacggttctgaaaccattcgtgcagccattctttctgtgccgaaaggtcagtgggaagcaggttataccatcggtatgacctatatgcagacattccgccgtattattgcaccacaagcgtttcgtgttgccgtaccgccattgagtaatacctttattggtctattcaaagatacttctctggcatctgttgtgacggtcacagagatgttccgtgtagctcaacaagtggcaaatatgtcctatgacttcttaccagtctacattgaagctggcttgatttactggtgtttctgttgggtgctgttctttattcaagcacgcttagaaaaacgttttgatcgatatgtggcgaaataacaatgattaaagtacgaaacattcataaaacttttggcaataacaccattttgcgtgggattgatttagacattcaaaaggggcaagtggttgtgattttaggggcgtctggctcaggtaaaactacctttcttcgctgtttaaatgcgttagaagtgccagagcaaggcacaataacctttgataacgatgccccgttgcacattgactttacaaccaaatcagccaaaaaagagatccttactctacgccgtaaatcaggtatggtttttcaaaactacaatctctttccccataaaactgcaatcgaaaatgtgatagaaggccctgtgtttgtacaaggtaaaaaacctgaacaagctagagaagaagccttagcattattagccaaagtgggattagcagataaagtcgatctctatccattccagctttctggcggacagcaacaacgtgtcggcattgctcgtgctttagccattcaacctgaattaatgctgtttgatgagccgacttctgccctcgaccctgaattagtgcaagatatgttaaacacaatgaaagagctggcaaacgaaggccggacaatggttgtggttacacacgaaattaaatttgcgttagatgtggcagatgttgtggtcgtgatggacggcggtgaaattgtggaacaaggctcgcctgagcaacttttcagcaatcctcaacacgaacggacgaagcggtttttgcatcagattaataaaaattgagcatctgagtactaagtggtttgtaataacttatgttcgtaatactgacaaagtggcaaaagcagcacaagagccttatttgttgatcgtaggcagtgcaggtagttgatttgttgcattgaatgtgaaattggttgatataccagcatttccacaagaaattcatctgttagcacggtgcgtattttagcgaacgaataggcgtaacgggttggttacgaaggggggcgggggaatatcgtttagacgatgattatatgctgatgaacggagaagcctcagcaggtatcagcgtagcagatttatccattgccattgcagacgattcggaatacaagcacatttgtttaaactctttactgggcgagtaggtaatttggtgtgaaaatatggtgtgggattttagaatattgagatttaccccctccccccgaaaaattattaatagcgttatttatttgtacacaataatggatatattgatatcgtcaggagaatgaatatgaaagcaagtgaattaaaaattgctgattttttaactagcacaaaagtacagtttactatccctgtatatcaacgtaattatgattggaaagttgaacaatgccagcaacttctaaatgatattttgagtatagggcaagattgtgatgtttctaatcattttattggaagtattgtttatattcacaataatggtgcttacacaagttcacaaattaaagagtggattattattgatgggcaacagagattaacgaccattatgttaatttatttggtgttatatcatctcacaaaatctcaagaaaaaaatgacttagccgacgaaattaatgaaactattctgattaataagttttcttctgcaccatataaattaaaacttaagccaacagataatcatgtttcagctatggaatatatttataaaggaaattttagtgaagggttgggttatttttcacgattggtggaaaattttaaatatttcaaatcttgtattactctagaaaacttagatatagtcagacaaggattagataaattaatgtttgtagaagtttcattagagagaggaaaggataatccacaacgtatttttgagagtttaaattcaactggcttagcattaagtgaggcagatttaattagaaattatatattgatggatttagagagtgataagcaaaatatattctttcaatattgggatataattgagaaatttgctaaagatgatgcaaataatgaaagtaaagtttctgactttattcgtgattatcttactaaaataaataaaaagattccaaataaaactagaatttatgaggcttttaaaggtaaatatccaagggttcaggagaaggatctattagaattaaaacagttttcaaagtattatggtatattagtaaatcctgaaagagaggaagatgtggatattcgattacacttgcaatatattaaattattggaggttaaaactgcgtatccttttttattaaatatttatcatgattacagttatttaaataaaattaataaggagcaattcattcaaattttagaatggttacagtcttttattgttcgacgtctagttgttggactcccaacaaatgcattaaataaaatttttatggcactatataatgaaaatgagttagtagtatcagaaaattatgtagcaacaatcgttaaatctttgtcaaaacgtacaaataatcagcgttttccgaatgatgttgaggtgattgaggcattaaaaaattgttctatatataattgggcttctaaaaatagaacctatttgtttgaaagactagaaaactttaagaataaagagtttatatccattataaataataaaaaaattagccttgaacatatttttcctcaaaatgcaggtgatgattggtatgaggatttagattcgcagcaatacgaatttatgcaacagaaattacatactttggctaatttgactttaactggatataattctgagctatctaataaaagttttatcaaaaaacgtgaattgtacaaggatagtcgattatggttaaatagctcattaagttctctatcgaaatggggaaaaaatgagtgggaagatcgatttactttattatcggaacgttttcttaatatttggaaacaacctgaatatgaagagcaagactcagaaattaatttaatggatgtaaatgatttaacctataggaaattgatttcagcacaattccaagatattcagttagaggttaataatgttacagagctttatagagttgtaattgaacaattattccaagaggaacctactagatttttagaaacccaattggctgaaaagttacgtattgttccagatggaaaaaaagacgaactacgagtagcagtagctttacctaataactaccaaatggaaactaattatagtaataatgataagttagctcgattaaaacaggttttaattaccttaaatttagaaaatgaattatttattcgtttagattcatttaataagaattaattgtaaagaaaaatgctctctctatgtattaatatatttttagaaatatttcgggagagcaaattatctttatcagactatataatacaatgtgtcttgtaaatatttaatacaatctcaccgcttgctatacatctaaatactccatcatactctccgccgcatcacgtccttcggcgatggcggtaaccacaaggtctgagccacgagtgatgtcgccaccagcaaagacttttggattggcagtttgttgtttgagttcgccagccgttgcaattctgccacgattgtctgtggtgacaccaattgacgatagccaaggcatttcgtgtggagcgaagccgaaggcgatgataacggcatcacaagcgatgatttcttcgctaccttcgatgatttcggcttgacggcgaccgttggcatcgggttcgcccagttgggttttgacgattttaatccctgttactttgcctgattggtcggtttccacagctaatggttcggcttcaatttctacgggttgagcgttgaattggaactcgacaccttcttctttggcattgctgtattctttacggctacctggcatattggctgcgtcacggcgataaacgcaggtcacttctgatgcaccttgacgcaccgatgttcttacgcagtccattgcggtatcgccaccgcctaataccaccacttttttacctgccattgaaacgtaatcaggggcagctaaaccgagcaaatgttgtgtgttgccaatcaggaatggcaaagcggaataaacgccttgtgcctgttcatttggaatattggctttcatgccttgataggtgccaacgcccaagaaaaccgcatcatattgggcaagcaaatcgtcaagactgatgtctttgccgatttctatgcccagtttaaattcaatgcccatctcgctaaacatctcacggcgacggctcatcacatttttttctaacttgaatgatggaataccaaaggtgagcaagccaccgatttctcgttggcgttcatacaccaccacatcaacaccgttgcggattaacacgtctgcacaacctaatcctgctggacctgctccgacaatcgccacttttttgttggctttgggaacgttttttactgttggtttccagcccatttcaaaggctttttcggtgatgtatttttcaacattaccgatggtgaccgcaccaaattcggcatttaaggtgcaagaaccttcacacaagcggtcttgtgggcaaacacgtccgcaaacttcgggtaagctgttggtgctgtgtgccagttctgcagcatcaatgatacgtccttcttgtgccaaacgtagccagttaggaatgttattgtgtaatgggcatttgtgctggcaataggggttgccacactctaaacagcggtcggcttgcgactctgcctgtgcttggctaaacatttggtaaatttcgataaactcgcttttacgactgtttaatggaatttttgacggatcaacacggggtaaatctataaattggtaaacattatcacggctcatttttgtgttccttctaataatcctcctctctagcaaagaggggttaggggagattgggcagacgaaatgtcgaagtgagagatttgtatggttctcatcattctttaattcgcattttgtcttcgttatccctttttaacaaatctccccctgcccctctttgctaaagaggggagcttgttcagagggaaattggcattttcatcttttcactttctactgcacaatcacacccaactcatctagggtacggcgtttgtgtcctagtagggcattaatgtcattcgctttaggtttcaccaagacaaagcgtgcgacataatcgtcccagttagcaaggatacgttcgccaatcgcactgcgagtaagttcaacgtggcgagagattaagccacgcaaatgctcttggtgagttggtaaatcgcaaatgcttagtccttcaaccagttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaatgcggttggcaaatttgccgtctgcatcgaacacataggcaaaaccgcctgtcatgcctgcaccaaagttaatccctgttttgccgagaatggtaaccacaccgcctgtcatgtattcacaaccgttgtcgccaatgccttcaactacggctaatgcacctgagttacgcaccgcaaagcgttcacctgcacgacctgatgcaaagagttctccccctgttgcaccgtaaaggcaagtgttgcctgcaatagcggcttcttcggctttaaaggcaacgccattgtgtggtttaatcacaatgcgaccgcctgccatgcctttgcccacatagtcgttggcatcaccagttaagttcaggttcacgccgcctgctaaccacacgccaaaactttgtcctgctgtgccgtttaggttgatgctgaaggtttgcaatggattgccacgattgccatagcgttgagccaccaagcctgaaagggttgctcccacagagcgatctaaattgctgatgtcgaaatccaaatccgctgataaaccgctttcaaacgcattttgggcttgtgccacaatcgctttattcaacaaaccttggtcaaaagcagggttggcttgggtgcagaaacggctactgccgtctggcacttttggcgaatagagcaatttagccaagtctagaccttgttgtttagcggttttgccattgatgatttctaataaatcggtgcaaccgattaagtcggttaatttctctacgccgagttctgccaaaatttcacgcacatcttgggcgatgaatttaaagtagttcatcgctttttcaggtaagccgtggtaatgctgattacgcaaagtatcgtcttgtgttgctacgcctgttgcacagttgtttaggtggcaaatacgcaggtagcgacagccaagtgcaaccataggtgcagtaccaaaaccgaaactttctgcccctaaaatcgctgcttttacaatgtctaaacctgttttcaaacctccatcgacttgtaaacgaactttatgacgcaaattgttttccaccaaagcctgttgggcttctgccaaaccaagctcccacggtgaaccgcagtatttcacgctggttaatgggcttgcacctgtgccaccatcatagcctgcaatggtgattaaatctgcataggcttttgccacgcctgtggcaatggtgccaacacccggcaaggaaacgagtttgactgagattaaggctttcgggttgatttgttttaagtcgaaaatcaactgtgccaagtcttcaatcgagtaaatatcgtggtgtggcggcggtgaaatcaaggttgaacccggtaccgcatagcgaagttgagcgatatatggggtaactttatcccctggtaactgacctccttcacctggttttgccccttgtgccactttgatttggatcacttcggcactcattaagtaagcaggggtaacgccaaagcgacccgatgccacttgtttgatttttgatactttttctgtgccataacgtttcggatcttcaccgccttcacctgagttggaatagccacccaagcggttcattgccactgctaaggcttcgtgagcttcggggcttaatgcaccgatagacattgccgcactgtcaaagcgtttgtataagttttccgcgggttcaacacggtgaagctcaatcgctttgcctgcttcggtttttaaacgcaacatatcacggatcgtggtaatcggacggttgtttaccacatcacggaaggctttgtatttttcataatcgcctgtattgactgccgtctgcaaggtgttcaccacatcagggttgtaagcgtggtattcgccttgcggtttgtatttgagataaccgcccatttcaatatcttggctgtgtcgccatgcacgtttacgacaagcggtctgttgttgctctaaatctgcaaaactagccccttcgatacggctggtgataccagggaagcaaaggttgatgacttcactatttaaaccaaccacttcaaacaatctggcacaacggtaggacgacacacaagaaatgcccattttcgacataatcttgtataagcctttgttgatcccgttgcggaagtttgccattgccacacgaagcggtttgttgattgcccctttttgcaccatatcggcaatggtttcataggcaagatagggataaactgctgttgcccctaaaccgattaacaccgcaaaatgatgtggattgcgtgcttctgccgtttccaccaaaatgttggtatcacaacgcaagttggcttccaccaaacaggtttgcaacgcccccaccgctaaggcacttggaataggttggcgttcagccgtgatgttgcggtcggacacaatcaacaacacggttttttcacgcaccgcttgttttgcctgctcgcataattgctcaatcgcctgttttaaggtcaattcatcaggattaaaggttgcatctagtatcgtgtgtttgtagtgttccgcaggcaaacgcaaaatctgttgcatatcggaatagaccaaaatcggtgatttgaaattcactcgatgcgacatgccttctgcttcaaagaacacgctcatttcacgcccgatactggtggcaaggctcatcacatgggcttcacgcaatgggtcaatcggtgggttcgttacttgggcgaagtattgacggaaatagtcaaacagcacacgtgggcgttcgctcaacaccgcaaaaggcgtatcatcacccattgaaccgaccgcttcctgtccgctctcaccaagcacacgaataacattttccagctcttccttatcataaaggaactgcttttgatacactttcagttgtaactcatcaagtgtcgcttcacccacttcgttttcaggcaactgctcaaagggaattaaacgttgaacgtgtttgtttaaccactcacggtaagggtgtctggctcgcacttcattgtcaatttcatcagaatgcaccaagcgaccgtgtttggtgtcaatcaccaacaactgccctggtccaacacgtcctttctctaccacttcatcaggggcatagttccaaatccccacttcggacgcaatcgtaatcaaacggtcttgcgtaatcacataacgagcagggcgtaaaccattgcggtcaagattacaagcggcataacgaccatcggttaaaacaatcccagcagggccgtcccaaggctccatatgcattgagttaaaatcatagaaggcacgcaaatcatcgtccatatcaggattttgttgccacgcaggtgggacaagcaaacgcatggcacggaataaatccataccaccgctaacaaacagctccaacatattatccaacgagctagaatccgaccctgtttcattcacaaaaggagctgccgtctgcaaatcaggaattaacggcgtacgatacttatacgccctagctcttgcccaagcacggttgcccgaaatcgtattgatttcaccattatgggcaagataacggaagggttgagccaacttccaacgcggttgagtattggttgaaaaacgttgatgaaacaaacaaattgccgtctgcatacgcaaatccgccaaatccaaatagaactttggcaaatctttcggcatacacaagcctttatagacaatcgtttgattagaaaaactacaaatatagaaatcagggtgattgatacgcttctcaatacggcggcgagccacaaacaaacggcgttgcaaatcctgcacacgccaaccgctaggtgcattcacaaacacctgcttaattgttggcatatccgccagagcaatttcccccaacacagacggattaatcggcacatcacgccacgcaggaatacccaacgtttcctgggttaattcttcattgataatctcaatatactctttgactaaggcttcatcacgtggcaaaaaaatctgtccaacaccgaaaatttttgccaaggtaaaaccgctttccgccgcaaccgcacaaaaaaagctctcaggcatctgcaaagaaagaccacaaccgtcccccgttttgccgtctgccaaaatcgccccacggtgctgcatacgggataaacctaaaataccattacgaaccaccttgtggctctgcaccccatctatattggctatcaagccaaacccacaattctcacgctcaaatgagctgttataaagttttgtcattcaaatcacttcctagttatttctttttaaatcggtaagtggtgtaagcatattagaaaaattaatgaaagacaatagattttttgattgagtatgatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtagataccataagacacaacaaattttatttcataaatgtgtctaaattaaatgctgtctgtttttgcaaaacagcctgtgcaatagtgactaatttacgcattaaagccgtgataatcaccattttaggtttgccgcattcaagcaatcgcagcacaaacgagcgatatacgctgtttttgtagctgccaaaggcaaagttcattgcagggcaaaagagtgccttacgaatgtcggattgcccgatttttgaaataccaataacggtatttaaacttttccccgaacttttaatcatcggggttaaacctgcaaaagtggcggctgctttcgcgtttttaaaacgatttccatcacctaaatgggcaatcagttgaacggcggttgcaaagccaatagcaggaatagtgcaaagtaattttacattgtttttcaatgtattatctgcattaatgcactgtttaattgttttttccaaagccttaatttgcgctttgatgaaggcaatcatctgctgtgttgaagcaatgcaatcgctgtcaagcaacattgttagccgtgttttttcttgtgccaactgttttttcaggtggtcaagttggcgatttttacgcaacaattcccgttgagcaggtgaaattggctgataaatcggtaatttatgacgcttttcatcggcataatcagcaagcatttttgcgtcgattttgtcggttttagagcgtaaattatcggttttcgtgaaatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagcattacattgacgttagtcacagaagaagcaccggctaactccgtgccagcagccgcggtaatacggagggtgcgagcgttaatcggaatgactgggcgtaaagggcacgcaggcggtgacttaagtgagatgtgaaagccccgagcttaacttgggaattgcatttcatactgggttgctagagtattttagggaggggtagaattccacgtgtagcggtgaaatgcgtagagatgtggaggaataccgaaggcgaaggcagccccttgggaaaatactgacgctcatgtgcgaaagcgtggggagcaaacaggattagataccctggtagtccacgctgtaaacgctgtcgatttggggattgggcttagagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagaactcagagatgagtttgtgccttcgggaacttagagacaggtgctgcatggctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtgattatcgawtgttctttaaaaawttggaaacaagctgaaaactgagagattttctgtaggggcaaatcayatttgccctgaaacaagaaagtctgagtagtaagaaaaatcttractgaacaaaagcrgtyaagtgtttagtagttaatatcaacttcaagtgaaaatgtttgaggttgtatrgttaagtgactaagcgtacacggtggatgcctaggcaatcagaggcgaagaaggacgtgctaatctgcgaaaagcttggatgagttgataagaagcgtttaatccaagatatccgaatggggaaacccgatggatgaagaatccatcatttcattatgaatccatagtaatgaaaggcaaaccgggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgccggaagaccaagggttcctgtccaacgttaatcggggcagggtgagtcggcccctaaggcgaggctgaaaagcgtagtcgatgggaaacgggttaatattcccgtacttggtaaagctgcgatgtggggacggagaaggttaggttagcagactgttggatgtctgtttaagttggtaggtgggaagtttaggcaaatccggacttccataacactgagagatgatgacgagtttctacggaaatgaagtaactgataccacgcttccaggaaaagccactaagcgaaaggctttactaaaccgtactgaaaaccgacacaggtggtcaggtagagaatactcaggcgcttgagagaactcgggtgaaggaactaggcaaaatagcaccgtaacttcgggagaaggtgcgctggcgtaggttgtaggagtatacctccgaaggctgaaccagtcgaagataccagctggctgcaactgtttattaaaaacacagcactctgcaaacacgaaagtggacgtatagggtgtgatgcctgcccggtgctggaaggttaattgatggtgttatcgaaagagaagctcctgatcgaagccccagtaaacggcggccgtaactataacggtcctaaggtagcgaaattccttgtcgggtaagttccgacctgcacgaatggcataatgatggccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtacttccacgactaattaaatggtagcagttaccacaatttccactttccaattggggttagccaattttgcttcaacagcagctcttggcggtgcattaccttcagcaacccattcgtcccaagctcggttcatttcatcaaattcaatcatattgcttacaaaaacttgagccatcaaaattcgacttttatttgtgcctgcttgggctaaccatttatcaatttcggctaacacttgctttgtttgaccgtacatatcttgcgaatcatctttagggacttgtcctgcaagataggctacaccgttataaattgccatttcagataggcgtttaccgacttgaaatcgttggatcattgtttctcctaatgaaagcggtgagtagatagcaaatttttgctattctctcactgcttgaaaatgaattactcgactttgacaatccagccttcaggtgcctctacatcgccaaattgaattctggttaattcagcgtataaacgtttagtgatagggccaacttctgtttcagaatagaatacgtggaagttatccccattttgaataccaccgataggggtaattacggctgcggtaccacaagcaccagcctctgcaaactgatctagttgatcgatataaacatcgccttcaatcgtttccatacctaaacgctctttagcgagatgaagtaacgagtattttgtgatacttggtaaaatagacgatgaagcaggggtaataaatttgttatcttttgtaataccaaagaaatttgccgcaccgacttcttcaattttagtatgtgtttttggatcaaggtaaattgcatctgcgaatttacgctcaacggctaattcgtgaggcaacaggcttgctgcatagtttccgcccacttttacaccgccggtaccgtttggtgcagcacggtcataatcagacacaaggaaattcgctggagctaagccacctttgaagtaagcaccaacaggcacacaaaagacagagaaaatatattccggtgcagcacgaatgccaatattttcacccacaccaatcacaaatggacgtaagtaaagcgttgctcctgttccataaggtgctaaccattcttggtttgctttgacaacctctttacaagaacggataaacatttccactggcacctgtggcattaaaaggcgatcacaggtagtttgcatacgtttggcgttttgagctggacggaaaagattaatcgaaccgtctttgcaacgataggctttcaagccctcaaaacattgctgaccatagtgcaatgcagtagaaccttcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgctgtcggtagttaattccccctcattccatttgccctctttccaatgtgcaataaaacgataatctgttttgatataagaaaatccgaggtttgcccagtcaatatttttagtcattgttgtgtcctttatttttttatatgagatatgagaaatttacaacgtttctaaagaaaaatgaatgttttcaatgaaaaaaataggattttttatcgaaagtgcggctttgggtggcaatttttgtatattctggtagaatagtaggaaattctgctataaaaaaccgcccaacatgggcggtagctaaaccaaaaggttcaaaatatacaggaagtgaaacgagtaacttttttgttactctagtctagtttcctagaccaatatgcaaacacaacatcatacttaaaattcaaaaatagctaaaagacagctatcactatccatctaagtatggtgctgaattttagagatgtttgaccagttatacaaacgagattttttaattttatttatcaaaaaaagtaatctaaaaaaactcactttttctagtaaaaattatgaacaataaaaagttaccgccactcaatgctctcaaggcatttgaatctgctgctcgtcatcttaattttacgaaagcagcagatgaactatttgttacccaggccgcagttagccatcagattaaattacttgaagattttttaaatattcaactttttcatcggaaaaatagggtgttagaattaacggaacttggtttgcaatattttgatgaaattcgtccgctattagagcaaattgctaaagcaacggataaaattcgttctaaaaataatagacaaattcttacaattagtgtgcctcaaacttttggtatgcattggcttgttcctcggttgagtaagtttcatgagcggttcccccatattgaggtcaggattaaaggtgtagatcaagatgaggctcagcttggaaaagaaattgatgttgctatttattatggttcaggtaaatgggagaatgtggaatctattcgcttaacagaagctccattagtaattttagcttctcctaagttcttagaggaaaatccgttaaaatcaccaaaagatctgattggaaaaacattattgcatgtatttagccgtaataaatggaagcgaacgattgaatattttggtttaagtgaacaaattgatgttgaggaaattggtccaatttttagtcatacatttatggcattacaagcagctttgtatcagcaaggtattgctattgccaacaagactattgctcagcatgaattagaacaaggaaatttaattgagcctttttctacaggattaaatgatgaaaaatcattttatgttgtttatccatctcaaatatcagacaatcctaaagtacagcattttgttgattggattacgaaagaaattaatatatctgagtagtataataactcaagaggaaatatgaagtatcagtggattttatttgatgcggatgaaacgttattttcatttaattcatatttaggtttacaagcagttttagcttgttatggtatagagttttcccaagatgattatgaagcttttcaagctgtgaataagcccttgtggcttgcatatcaaaatcaagaaatcacaattgaacagcttcaaatatgtcgattctctaacattgcaaaaaaaattggaaaagacgaattagctttaaataatgaattaatgttaaaaatggctgtaataagtaaaccattatctggaactatagaggtattagaaaaattgtttggaataattagaatgggaattattacaaatggtttagaaatattgcaaaagaagcgtctggaaaatactaatacagaaaagtattttgatattgtgattagttcggaggttgcaggggtgccaaagccagatgaaagaatttttaagtttgcttttcaacaaatgggagatataaataagtctagaatattgatggtaggagatactctttcttctgatattttaggtgcaaatcaaataggtattgattcttgctggtttaatccttgcaaggaagttaatcatacagaaattaagccaacttatgaaattacggatttaaagcaattacttaatattgtactaagttagaaataaaggatatatacgtgaaattacagcagttacgctatattgttgaaatcgttaatcaaaatatgaatattacagaagctgctgaggtactttatacatctcagcctggaattagtaagcaagttcgtttgttagaagatgaattaggtatacatatttttgaacgatgtggaaaacatattaaagcgcttactccggcgggggaacgtattattacaattgctcgggagatgttggcacaagctcaagggattaaatctattgcagaagagcaaacaagtccgcataagggaatactcagaattgcaactacaaatacccaagctcgttacgtattaccaaagataattgaaaaatttaagaataaatacccctccgtaagtttacatcttcatcaaggatctccaacacaaatatatgatgcattaatggcaggagaggttgatttagctattattacagaggctcaatatctttttgaaaatgttattctgttaccttgttacatgtggaatcgttcagtgattgtaaaaccagatcatcctttggccaagctaaataagggaaataataaattaactattgaagagttgggacaatatgatttaatcacttatacatttggttttacggggcgctcagatctggataaggcttttaataaacatggtattctacctagaatagtatttacagctactgatgctgatgttattaagacctatgttcgttctggcttaggtattggaattatggcaactatggcatatacgaaggaagacaaagatttagttgctattgatgcaagccatctttttcaatctagtatgacacaaatagcttttaagcgaggtgtttttttacgtaattatatgtatgattttatcaattatttttctgctcatttaactaaaataaaagttgaagaagctgagcaacttcgtgataataatgcgattgctaggctttttgagtacgttagtttagaggaaatttaatgaatgcattaaaaaattagaagtattaattatttcttttatttgtattgttcaatctataagggcagaagagtttcatatcaagtataagtctaattatataatgccgacatatatccattttaaaaagagtgatgaatattattcaataatatctaaaattaacattcctttatataatatagtatttaatacaggtggtaaaatacaaggtaaacaatttaatatgttgaattaccaagatataagaaatgggaaaacttatgctaaggcagaggttaagggaacagtaattcaatacgggaaagtagtagaaccacttaaacaggagatcttaactttaccaacgtttgatttattttctattgcatttcaactcagctattatggagtattaccgtataattttcaaacgacaaatggtaaaaaaactttatccacataaggatacgattgtaaatgaatctagagctattcttagaataggagaaatagatgttgaggaaataacttacagattcaaaacgggtgctaaacagattatagtgaagaaattttcaggtgaaaaaatttcctcgttatatttcttataatagggatggggataattatgagttaatttttgatagttttttgaactaattttaactaacactagttctgattaatcattattgacatatatgtaatatattagagttgcaaaaaattattaagcaatgtaaatttttgtgaaaagtgtaggagatgtcacatttttctatttttcttgatgacaacgtttgggaaatcagtagagtagttgcttatccatcttatggcttttctttgaacctttagtattatggacgatagttatatatttcccttaagctccccaataattcggattttacaaattaccgattcacatttatttgcatcagatacttgtgaactattaggggttaataccactcaaagttttcaagctgtgcttaatatgatcatgaaagaatcatttgagtatgacttgattcttgcaacaggcgatcttgttcaagaccataatcgagaggcatatcatcgttttgcaaaaatggttaaaccgttggttaaaccactcttctgggtagctggaaatcatgatttacaaccacagatgcgtaatgctttgtctatttattctcaaattaaacctgaaaagcatattttagttggtgatcattggcagataattcttcttgatagccatattcaagatagccctaaaggtagattagagtcttctgagcttgcttttttaaaaagaaagttggaagtccatcctgaacgatattctttaattgttttacaccataatattctgccaacaaattcagcatggcttgatcagcatagcctttctaatgtaaatgatctacttgctacattaaaagcttttccgaaagtgaaggctattgtacatgggcatattcatcaagaggttgatgctcaatggaatgggtatcgtatattatcaacgccttcaacgtgtatacaattcaaaccacattgtaatgatttcacattagatgcgattcctcaagggtggcgtgagctttgtttaaatattgatggctcgattgatactgtggtaaagcgtttagataacaacaattttttacccaattttaaagcattgggatactagagaaatttatcctttttaagcagccattaagattaggagtaatagacaaacagttgttagaaatatttattctcaattattttgtattctatttctattcaatttgattttcgcagtgtccccctttttgtaaacagcagatattatacagtgtcacatctgagatattcatcaatgcttcttctgttaaaaatgcttgatgccctgttaaaagcacgttatggcaagaagacaaacggcggaaaacatcatctaaaatcacttcatttgatttatcttcaaagaaaagatcacgttcgttttcataaacgtccatacctaacgcaccgattttacgacgttttaatgctttaatcgcttcaggagtatcaattaatgaaccacggctggtattgatgatcatcacgccgtctttcattttgtcaaaagcctctttattcaacagatgatagttctctggcgtagctgggcaatgtagggttatcacatcggacttagcataaagttcatcaagtgtgacatattttgccccaatttcttccacaataggatttttaaatgggtcaaaggcaagaatattcattccaaagccttttaaaattcgcgttgttgcaataccaattttccctgtgccaatcactccaacggtacgtttgtacatattaaatccgattagcccttcaagagagaagtttgcttcacgggtacgctgataagctcgatgaatacggcgatttaaagtaagcatcaagccaacagtgtgttccgccacagcttcaggggaatannnnnnnnnnnnnnnnnnnnnnnnnnnnnnntctttggctgcttgaatatccacattgttaaaactggcacaacgcaaagcgatcattttcacgcccacttttgccagtttctcaagcactgctcggctaccatcgtcatttacaaaaatacaaacaacatcgcaaccttctgccattttagcggtacgctcattgagcataaaatcaaaaaattcaaactcaaaatggtattgttgattagctatttcgaggtattttcgatcataatttttggtactaaaaacggcgactttcattgtgctttcctaaataagtttatcattcactaattcaaatgcattagatagttttattgagaattcttgaggagtatatttatctattttttctttccatattctaatcatctcatatctatttgttaagctagtgtcccaacattcagaaactaaagataaatcaatacaattcaatatatgtttaatacgagccacatacttaaacaaaaaattatagtgtagtttagataattcatgagtacctaaaactttaaaaataaattttagatcttcatcaatatcctctattctcttttttcctcctgcagaatattgatctctcatatttggacaaataatagaatagtaagaaacccaaaatgcacatagtctcgaataatttgaattaaaaacttcagggtaaaggataaatccctcagcaataagatctcgtttttgctctttttctaagtttgtaaaatcaataatttcaaaatttctactaaaagtactttcctcatcaatccaccatagtgaattatcttttcctaacttagatttataatatttcttaatagatttaactggttgttcctgatttcttaattcatcatatgatatattcattaagtcaaaaatagattcacctttcggtaaattcatatctatttcatatctaggataatgagtaacagaaattccaaataaacaatcctcataagttctgtacttaatatcgggtattcctccacacttaccaaagaacatataaattttctttacacactcaattctagacgattcaagtacactattgcctatggacttccatttatcatccttagtaaatttaacctcaactccccagtaattatttataacaatatcagggaaatctctgtctgctgtacgatataaattccctttaaataaagtaccatcagcacaaacttgcatacagttaaaaaccaaactttcaaatttgttccctgaatttattgatggatctaaattttttagtaccagatcacgagttttatctaataactcttcaaatttctgtttttcatttatatccgctgtagtataaatcatttcagggtttcctttacagattgagcaagatgccatgcaaatacaggggctactgcattgcctacctgcctataagcatcagtcgtcgaatttaaaaactcaaagttatctgggaacgactgaatacgagctgcctctctagcagagagcctcctcggcaagctatagtgaaattcaatatttccatgatgctcagccctcattgttggacctgggcgatccgcttttgttttggtgtttccttgagttccttgaaataacttagctttagaatagccactatttggtagagaaaaatgtttttcatcattttctaaatcaccgattgccctttttaaatcaacccatttttctgtagattgaaataaatcctcgctatctgaatgagtttctcggggaaagaaaaattctgatgtcaaatcattgcgaacaccgacaattattaccctttctcgagtttgaggaacaccataattagctgtattcaatagttggtatttaattttatagccaatctttccaaaatcttcgacaatagtatttatagctaaaccattttgccatgtaagcaatcctttcacattttcagctaaaaatagtttaggctttaccttatctacaacatcaaccatactgagataaagatttccacgttcaaccgctaatccttgtcgctttccagctaagctaaaatcttgacaaggaaacccacctagaacaacatcagcttcaggcaatgtacttttatcaactagtgtaatatctccacatactacgggagtttcagggaaattatgttttaaagtcttacaagctttttcattaatatcgttcgcccaaaccacttcgaagggattttcatcgtatcttttatttaaaaagtcaaacccacctttaaatcctaaatccaaccctccagctccagagaataacgaaataactcggaatttcttactcatatatcccttacacttgaacaatatcaatacgattatgctgttctgccactcttgctcgaattttcgcttcgagttggtcgatcaatttatcattgtcaaaacgctctttttgacgaacgccatcaagataaaaaccgctcattttatttgagccggtcacgccaagatcagacactaacgcttcacccggaccattcaccacacagccgataatggatacgtccatcggtgtaataatatcttccaaacgttgttcaagggcattgaccgtgccgatcacatcaaattcttgacgagagcaagttgggcaagcgataaagttgatcccacgagaacggatacgcaatgattttagaatatcaaagcccactttgatctcttcaacaggatctgcggctaatgaaacacgaagcgtatcaccgatcccctctgaaagtaataaacctaaaccgattgctgatttcacagcccctgctcttgcaccgcctgcttccgtaatgcctaaatggatcggttgtttgatcgctttagctaacaagcggtaagattcgacggctaaaaagacatcggacgctttcacactcactttaaattgatcgaagttaagacgatctaagatctcaacgtggcgaagtgctgactctaacagggcttctggcgttggctcaccgaatttctcttgaatatctttttcaagagagcctgcatttaccccgatacgaataggaatatttttatctctcgcacagtccaccaccgcacgaatacgctcttccttgccgatattacctggattgatacgcaagcaatccacaccatattccgccactttcaacgcaatacggtagtcaaagtgaatatctgcgacaagcggtacttttacctgctgttttatcaatttaaaggcttctgctgcgtccattgttggcacagacactcgcacaatatccgccccgacacgctcaagagctttgatttgtgctacagtcgcttccacatctgtggttcgtgtattcgtcattgattgaacagcaatcggtgcatcgccccccacaggcacattaccgacataaattttggtcgattgacgacgcttaataggtggttcttttaacatattattccgctaaaggtaatttgaaacgtgcaactcgtccatctactttcagtggaacaacttgccctttgtaataaattttgacgttagcaggcgcccccacagttaaacgatattgttcgttatcgttaaaacttaatacttcacctgccttataaagtctttctgctaagcgtttgttttgtgcagtacgcacagtaatccaactttcagcccccgtaatctcaatccgcagttcttcctctactgccgtttgtgtaggttcttccgcttgattatttgcttctgtttgtgtaagcacaggctcagtttgcacagattgaactagctcagcttgctctacggcaacaggcgtgctgctctctgccactgctgtagtagtggcagtcgtttggttctctgaagctacttgagctacaggctcttgatgattactttccactgctggtgttgcaggttctgcatttttagcaggcaatgttaccgcttgcggaacttctgctggggttggttgcggttcaaccggtgtcacttgaggctcttcggcaactttagctgttgcttcagtggtgttcacaatcaactgctcacggttagcctgatctttctgatgctcttgccaccaccaagccaacgtcataccaacggcacttaacaacacaatccacgtcagcccttttacccaacgcatttgcgacttatggtttttaaccgcaatcggtgcagcttttcggacttcttttggaattgtcacttcaccgtaattcactgaatttacaagggtttcaggcaaacgcagaaaacgcacataattacgcacataaccacgcacgaaagctggtggcacgcttggcaaaataaaaatatcattctctatcgcttcgaggtggctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcagatttgtttttcgagccacgtcctaaagaaagtgtcattgtttccgtcattgtcattgctttttctatataaaaattaggtgagaagtttaaagaggtatagcttgttttgcaatcctcaattcattaatcaaagcgaatttccctaaattagctagagtatacgaacgccatttgtgacgctcgctcaacttacttcacactaccacaatttaaacagtagagataactctgcttaggatcattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgccaacataccaagctgttgctgagtttgttgaggcaaaggcaaattcaaccattcaacagcttttaattgtaattgcaatttgaaatcacgcattacttggcttatcaaatcatcactttcatcaattagccactgtgtgctaaagcgttcgatttctgtttcccctttcgctttacgtttttcattgattaagattgttaaagcgtgataggcatcatcaaaatcgcccaactcatcaaccaaccctttttcaaatgcactttccccaagccaaacttgcccttgagccactttatctacatcacctttcgacatttttcgccccttgctgactaattcaaggaaacggtcgtagccattttcaatgctaatttgaattaactcactttgctcttttgatagcgattttaatgctgtttgttgtgcaaaaggcgatgtactaacaccatcttcattcacacctagttttttcgccgttttctcaaaactgacagctaaagcaaaaataccgatagagcctgtcaaagtagttgggcttgcaatgattttatcacttgttgccgcaatccagtaaccacctgaggcagccattccgcccatcgatgccacaacaggtttgcccgcttgttgcaaatcctcaacctcttggcgaattaattccgatgccattgcactcccacctgggctattaatccgcaatactacgcctcgcacgtcatcatcttcacgagcttttctcagcaattttacaatcgtatcactgccagcaacttcatcatcgctttcccctaacacaatcgccccttcaacattcacaatagctattttatccttgcctaccacattaaagcggtcagataacgacaaagaatagtcaaaaaagtcgatatggttatagtttccgtcttgatcttcaccaaattgctcaatcaagtcgaggcgaatttgacgatgcgttgccacgttcgttacccatttttgcattaaggcgtattgagcatcatcacctttcacagctttatattgagcgattaaacggtttgcttctggcactattgtgtttgcatcaatatggcgatttttagcaatcgcactgctgaaatttgcccataattgagatagccataattgagcattttgacgagcttctgccgacatatcatcacgcagaaacggctcaacggcagacttataggttccaacacggaaaatatgcggaacggcttcaatcttgtctaataacgatttgaaatagagtgtggaataatttaaaccgtgtaaatccacaaacccagctttgttcagataaattttatccgcataactcgcaaggtaatattgttgttggctatatccttcaccgattgcaatcacaggtttatttgattgtttaaaacgttcaatctctttgcctacataggttaaagaaggaatatcgcccccttcaaaataacttaaatcaagcactaatcctgtaattttttcatcatactgtgctttctttattgcacgcactacatcaaaggttgatattttaatcggttcatttctaccgcctaattcagaacgtaaaaagcggttaaaatcactaaattcatcgtgattatccgctaaataaccatctaaattgagcaataaagcccctttactaaattcgacaggtgttttgctgttagcagcatcacttgaccataacgccataaaagcaaatcctaacatcacaaataaaataaataccagacttatcacaaattctcgaatacaacgaaatagatgataagcccctttgagtagatgtagcataaaaaatccttagaagtgaagagggctattaagccatcataaaatagtaagaaaatataatcctttcaaaaactagatttgattgtgcttttgtaagaatagatagaaatatgtctctttaataattctatctgattttttctttgaaatgaatatttggcagaatgaacatttagttttagaatgggaaactatgattgatcagaaagtataaaaaatggcaaataaaaatcctttttctcttgatgatataactcaagaccactctacttggcagacatttaaacgcctatggcctatgatttccctttttaaaatagggattattgtggcgatggtggcaatgatatttaacgctgctgccgatgcatacttgatcacaatgcttaaacctttgattgatgaaggctttggcgttgactctgatcgtaactttttaaaagtgatggcatttattgtcgtaggcttaatttttgctcgtggtatcaccagctttatttctgcctactgtttggcgtgggtgtctggtaaagttgtgatgacaatgcgtcaaaaagtatttaagcatttaatgtttatgcctgtaacattttttgaccaaaactcttcaggaagattactttcccgtattacctatgattctgagcaagtagcaagttcttcggcaaatgcgttgcaaagcgtggtccgagaagggatctacattgtctttctcgtcacaacaatgttttattatagctggcgtttatcccttgttcttttcatcattggtcctgtgattgcggtattaatccgagttgtgtcaaaacgctttcgtaaactcagccgtaatatgcaagaatctatgggaagcatgaccgaaagtgccgaacagatgttgcgtggacataaagtggtgttatcgtttggcggacagaaagtcgaagaagaacgcttcaaccataccagtaacgatatgcgtcgcaaaggaatgaaaatgatggcagcaagtacgattgccgatccgattattcaagtgatcgcttctctagccttagcggtggtgctttttgtcgcaggttcgcctgaaattattggtgatgatttaacggcaggggaatttgctgcggttataggggcgttgatgggaattctacgtccattaaaaactttaaccaacgttaatgcccagttccaacgaggaatggcggcaagccaaacgctctttaccttatttgatttaccaacagaaaaaaatgaaggcacttatcaaattgaacgagccaaaggcgacattcgttttgaaaacgttacctttacttattttggtaaagaacaacccgctttaaaaaatatctcgtttaatttacctgcagggaaaaccttagcgttagttgggcgttcaggctcagggaaatcgaccattgcgaatttgattacccgtttttatgaaattgattcgggcaatatttatcttgatgatcataaaattcaagagtatactttaaacaatttgcgtgaacagtgtgcaattgtttctcaacaggttcatctatttaacgacaccattgcgaataacattgcctatgcagctaaagacaaatacagtcgtgagcagatcgaagctgcagctaaagccgcttatgcgatggaatttatcgaaaaaatgccacaaggcttggatacagtaattggtgaaaacggggtaagtctatctggtggacagcgtcagcgtttggcgattgcccgtgccttattaagaaattcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgttttagtcttagatgaagctacttcagcgttagataccgaatcagaacgtgcaattcaagcagcccttgatgaactacaaaaagatcgcactgttttagtgattgctcaccgcttgtctaccattgaaaacgccgatgagattttagtggtggatcagggagagattattgaacgcggatcacacaaagtcttgctggaaaaaggtggtgcttataaacagctatatcaaatgcaatttagtgaataatatacattctaataatttagagagattaggttgaatagtaaattttgtgagctagttctcagaaatataatttatgttatacatttcttacaaaatttaggtagaatacaagaaatcagactatattctaggagttattatgaattatccaatacttataaaccaattaaaagaagaattttttagtggctggaaaccctttgaggtagcttggcttttcttatttattgcagctcaaattggcgtatatatttactaccccgattctatcattggaatggtggcaggtatttcaggtattatctgtaatgtttttgttggtaaaggaaaaatcagtaattatttctttggtttaatttttgcatacagctatttctacgttgcatggggggcaaatttccttggtgaaatgaatacaacgctctatgtttatatccctgcgcaatttataggctatttcctttggaaacaaaatatgcaaaaagccgaaggaagtgaggcggtgatcacaaaagcattaactattaagggatggactggattattaacttttatggttattggaacattattattggttcaagccttgaaggccgctggtggcagttcgacaggtttagatggtttaactacaattattgtggttgcggctcaagcattaatgttactacgttatcgtgaacagtggctattatggattgccttaaatattctctctatcgttctttgggctgaaaatccatcaatgtacataatgtattctgcatatttattaaattccctttatgggtattataactggacaaaactacaaaaagcctaataaataaaatctcttataaatcaaaggttgagacttctcaacctttcgtttttccgctatccttggcaaaaatttttttcttagataacacattgcaactgacattaccgatccatcaaattgatgatgatacttttgacaacttttacgccgaaaacagtttattgctgttggggtcgctacgccaaaattttgtggatgttcagcaaccttttttttatatctggggcggtaagagcagtggcaagagccatttactcaaggcggtgagtaatcattatttgcttaatcaacaatcagcaacctatattccattggataaatcccattacttcgcccctacggtattggataatggggatcaacttgatgtggtttgtcttgatgatatacaagcggtggcaggtgatgaagagtgggaattggctattttcgatctgtttaatcagattcgtgaacagcaagggttgtttaatcaatgtaagaaaacattattgttgatcagtgccgattgtccgccacatcaattagctattcacttgcctgacctgcgttctcgcttaacttggggcgaggtatatcgtttggcggatcttgatgatgaacagaaacgcattattttgcaacgtaatgcacgcaataaggggctagagctttcagatgaagtggcgaactttttactcaagcggttagatcgtgatttacaagccctaatgcataaattaatgttgttagatcacgcctcgttacaggctcaacgtaagctcacacttccttttgtcaaagaaattttaggactataaatggatcaactttcgctcattaatattgcttgtgaacgtggtgaaactcgcttgtttgaaggctgttcattgactatttcgagtggtcaatggtggcaaatcgaagggcataatggcattggaaaaaccagtctattgcggattttagctgggcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcggattttagctgggtttgcagtggcggcagaaggcgaggtgcagtggaatggtgttaaaattcagcaacaacgagatcaatactacactaatctcttttatttagggcatcacgcaggggttaagcctgaactgaccgcttgggaaaatctgcgttttttccaaaaaattcaagggttgcctttagatgatgaagccctttggaatgccttaggaaaagtgtcgttgattgggcgagaagatttgccttgctcgcatttgtcggctgggcagcaacgtcgagtggctctggcaaaattatggctgaccaaagcgacgttatggattttagatgagccttttactgcgattgataaaaaaggggttgcggaactgatcgcccatatcgaacaacattgtgagcaagggggtatggtgatttttaccagccatcaaaccgcagaaagtgacaaagttcaagtgttatcgttagatccatttagagtataaaataaccctatgattttactgactattatccaacgagaattaaccatcgcctttcgtaaacctgcggaaattttaaaccctttatggtttttcttgattattatcacaatgtttccgcttttaatgggccctaatcctgaattactcgctaaaatagcctctggaactgcgtgggttgcggcggtgctttcagccttgctctcttttgagcgactatttcgtgatgattatttagatggctcattagagcagttgatgttgctacccgtcggtttgccgcaagtggcgttagcaaaagtgattgcacattggctattaactggcttgcctttaattctgctttcgccgattacggcgattttgctttctcttgaaacagaagtgtggtgggcattggttttaaccctattgttaggtacaccgattttaagttgccttggggcaatcggggttggattaactgtcgggttgagaaaaggtggtacgctactcagtttattgatcttaccgctctttctacctgtattgatcttcgccgctgccgtgttagaagcctcaaccttaaatatgggatatacagggcaacttgctattttaggggcaatgttagccctcgcattaaccttttcgccttttgcaatcgcaggggcgttaagggttagtttacagtaacaagcggtaatttgaaccctattttttgtaataacttggagtttttatgtggaaatggttacacccttacgcaaagtctgaaacacagtaccatttgctagggaaggtgcagccttggcttgcagtcttaagttttttattgctttcagcagcatttattattggcttggcattcgccccaaaagattatcaacaaggcgatagctatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcattattttcattcacgttccagcggcaatttggtcgatgggtgtttatggctcaatggcagttgttgcactcattgcagcggtatggcaaattcgtcaagcacatctagcaatgatctcaatggcaccgattggaatggtctttgccttcctttctcttgtgacaggagcaatttggggcaagccgatgtggggaacttggtgggtatgggacgcacgtttaacttcagccttagtattatttttcctctatcttggcgtaatggctctttattctgctttccaagataaaaatacaggggcaaaagcggctggggtactttcaatggttggcgtaatcaacttaccgattatccacttctcagtagagtggtggaacacgctacatcaaggggcaactatcactaaatttgataaaccttcaatggcaaccgaaatgttaatcccattattattggcgattttcggctcaatgatctttatgatttgggtaagcatcgtgcgttatcgcagtgctttacttcaagacgaacgcaaacgcccttgggtgcgtgaactcgcaaaattaagtaaataggagagaatatgacctttcaatttgcatcacttagtgattttttctcaatgggcggttacggcttctatgtatggctctcttatggaattacttttctttctgtcggtctgttagtttggcaaagtaaacgtgaaattcgtcagacgttgcagttggtgaaaaaagagcaagcgagagaagatcaactcagtaacaagcggtaggatattggataatcttttctaaggtaggcaagagcctacctttctttttgttaaaaaattgtgatataactcacaaatccaacatttgcttattttaataaattactgttttgctaaactaatctggtttattgatctacatcattttattttgtgggggctttatgtcggtagcgcatcaatcatcaaacccaataataaggaatggacttattctgttatttgatattgttttattctttgtcttattaaatacattaccttttgaacccgctgtaagtaaaggtttagccttattagtatttgttgcagttttatggcttacggaagctctacacgttacagtaacggctctacttgtgcctattctggcgattggtctagggttagtaaaatctaaagaagccttaagtgcttttgccgatccaacaatcttccttttctttggtggttttgctttagctacagcattacacattcaacagcttgatcgcctgattgcaaataaaattatggcaatggcaaaagggaaattatccattgcagtgatttacctattctctgttactgcatttctttcaatgtggatgagtaatacagcaaccgcagcaatgatgttaccgcttgcaatggggattttaagtaaattagataaagaaactcaccacaacacctatgtctttgtattattagggattgcttatagtgcaagtattggtggaatggggacgctggttggtagtccaccaaatgcgattgtggcatcacagctgaatttaacttttgcagattggttaaaatatggcttgccgattatgtttatcttgatgccattaatgatcgcaacgctatatgtggtatttaaaccgaaatttgatgttacttttgagcatagttttgaaaaaattgagttaaatcgcgaccgcattattaccctttctatcttcggtgttatcgcaatttgttgggtatttggcgataaaattaacccactaatttctggcttattagggctacaaggtaaaattggtagtttcgacagtatcgttgctctttttgctgcagtcttaatttgtatcactagagttgcttcgtgggacgatattcagaaaaataccgaatggggcgtattaatgcttttcggtggcggtttaaccttaagctcagtactaggtcaaacaggggctagtaaagtaatggcagatggtatcgtattcttaattgaagacggatacttctaccttatcggattactggttgcagcatttattattttcttaacagaatttacctctaatacagcaagtgctgcattattagtaccaatctttatttctattgctcaagccttaaatatgccgccagtagggcttgcattaattatcggcttaggtgcgtcttgtgcctttatgttaccagttgcaacaccgccaaatgcgattgtatttggtacagggcaaattaaacagagtgagatggtgaaagctggtttctggcttaacattatctgtatttttgtcattgcaacggcagggtatttgttctggttgtaatccgtatctttatgcaaaaagcggtcacttcgtggccgctttttgcatcttaaggaagataggatattggctcgatttgaatgtttttgagaagattgtgtcaaagaacataattactttattttatgaagaaattcataagatcaacgaataatttgatctacattacccaaaatataattgaaactgttataatcgccccgttttttatttttgaaaatcaaaagaggaactaactatgtccgtaaaaaaaatggcagatcttgacctagcaggcaaacgccttttcattcgtgcagaccttaacgtgcctgttaaagatggcaaagttacatcagacgctcgtatccgtgcaacaatcccaacattaaaattagccttacaaaaaggggctaaagtaatggtgacgtcgcacttaggtcgtccgactgaaggggtatttgaagaagcaaactctttacaacctgtggttgattatttaaatgcttcagatttaggtgtttctgttcgtttagtgcgtgattacttagatggcgttgatgtaaaagaaaacgaaatcgtggtgcttgaaaacgtgcgtattaacaaaggggagaagaaaaacgatcctgagttagcgaaaaaatatgcagcactttgtgatgtatttgtaatggacgcattcggtaccgcgcatcgtgcagaaggttcaacttacggcgtggcagaatacgcaccagttgcttgtgcaggtccattacttgcagcagaattagatgctttaggcaaagcattaaaagagccacaacgcccaatgcttgcaattgtaggtggttcaaaagtatctactaaattaactgtattagacagtctttcaaaaatcgctgaccaattaatcgtaggtggcggtatcgcaaatactttcattgcggcagaaggcaacaatgtaggtaaatctttatacgaagcggatttaattcctgaagcacaacgtttatctaaagcaacaaacattcctgtgccagttgatgtgcgtgttggtttagagttctctgacgctgctgcggcaacgcacaaagcagtaaacgaagtagctgcagaagaatcaatcttcgacattggcgataaatcagcggaagagttagcagaaattatccgtaatgcgaaaacaatcctttggaatggtccagttggtgtatttgagttccctaacttccgtaaaggtactgaagtggttgctcaagctatcgttgatgcgacagcaaacggtgcattctcaatcgcaggtggcggtgacacattagcagcaattgatatgtttggtatcgcagataaaatctcttacatctcaacaggtggcggtgcgttcttagagttcgtagaaggcaaaatcttaccagcggttgaaattttagagaaacgtgcgaatagctaattttattcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngataaaaatcccaaactagaaggaaacaaaaaatggcaaaattattagacatcgtaaaaccaggtgttgtaacaggtgatgacgtacaaaaaatctttgcttatgcaaaagaacacaacttcgcacttcctgcggtaaactgcgtaggttcagactcagtaaacgcagtattagagactgcagcacgcgttaaagcaccagttatcgtgcaattctcaaatggcggtgctcaattctacgctggtaaaggtatcaaaccagcaagtggtgctcgtgcagatgtattaggtgcaatcgcaggtgcaaaacacgttcacgaattagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaaagagtacggtgtaccagtgattcttcacacagaccatgctgcgaaaaaattacttccgtggattgacggtatgttagaagcaggtgaaaaatacttcgctgaaacaggtcgtccattattctcttcacatatgattgacctttcagaagagccaatcgaagaaaatatggaaatttgcaaaaaatacttagagcgtatgagcaaaatcggtatgacccttgaaatcgaaatcggtatcactggtggtgaagaagatggcgtagataacagcgatgttgatgagtcacgtttatatacacaaccagaagatgtgttattcgtttacgattcattaaacccagtaagtccacgtttcactgttgcagcagcgttcggtaacgtacacggtgtttacaaaccaggtaacgtaaaattaaaaccatctatcttaggtgcatcacaagagttcgtatctaaagagcgtggcttacctgcgaaatcaatcgacttcgtattccacggcggttcaggttcttcacaagaagagatccgtgaagcaattggctacggtgcaatcaaaatgaatatcgacacagatacacaatgggcatcttgggcgggtattttagattactacaatacaaacaaagattacttgcaaggtcaattaggtaacccagaaggccctgattcaccaaacaaaaaatactacgatccacgcgtttggttacgcaaaatggaagagtctatgtctaaacgcttagagcaatctttcattgacttaaattgtgtagatgtattgtaatttttaaatatcgcttttcgtttcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgaaggcggaagggggcaattaatttaaacgaaaattttgtaacatcgttgtaattccccccaccctaaccttaccccgtaaacgggggaagggattatttcttagcctttcaaaataactatggcacttccacttcttgatattcagtccgtcagtaaacgctttactgatcgcattggcattttccgtaagcaagatttttatgcggtaaaaaatgtttcctttagcttatatcaccaagaaacccttgcgattatcggggcgaacggagcggggaaatccaccttagccaaaatgctcgtaggtattactgaaccaacgtcgggcaaaatgtttttcaaagatcacgaattgacctacggtgactacgcttttcgagcgaagaagatcagaatgattttccaagatccaaatgatgcctttgatcccaattataatatcgggcagattttggattcgccactgaaacttgctacccatctttctgaagaaaaacgtaacgaacggatatttaaaaccttaaaattagttggtttgtatcctgaacacgccttgattcatataaaagaggcatcaagtagccaaaaacagcggattgcattagcaagagcgttgattctcaatcctgaaattatcatcattgacgacacactcagtgccttagacttttcggtgaaaacacaattaactaacctaatgttaaatttacaggaacgtttaggattatcctatatctatgttggacagaatctcggtatgattaagcatatcgcagataaattgatggtaatggatcaaggtgaagtggtcgaatatggcagtaccaaagaagtgctattgaaccctcaacacccaatcacaatacgtttaatcgaaagccattttggcaaacgcctcaccccagaggcttgggcaaattaaaaaggagatgttatgcaacttattgatgtcatcaaacaacgcaaaacaataaaaatgttcaataatcaagttcagattagccgtgaagaactcaccgaaatgatcgaacttgcccagcttgctccatcaaaagccaatcttcaaccgtggcggtttgtgatattggatcaggcagaacaaaaacagaaactgttggataaagtcgcctttaacgcaccgccttgtgaaagtgcttcagcggtagtcgtcattttggcggatcttcattatgaaaagttacttggcgatgtgttagatcattctattgcaagcggctgtttacaccaaaattttcgcgaaaattcctttaatttcttaatgggcgtacacaatacactcagcccacaggatattcgagatcaagtgttgattgatacgagtttagcggcaatgcagctaatgttagttgtcaaagagaaaggttacgatagccacgctattggtatttttgatcgtaaggcagtgttagaagtcctagaaattgacagcgaacgttatgccccagtgatgttattagcgattggcaaagcggctgtgccagccttaccaagcgtccgtttaccgacagaatatacggtttcgtggaatgatggaaaacaattccgtaaataatttaccctgattcaagcagtcagatttgttaattcttttacaaaaaattgttaaaatctcaccgcttttattttattgagaaacaactatgaatacattaaaaaacattcagttaaaacaaagtatttttagcaaaattatctttgcaagccgttggttacaacttcctatttatttaggtttaattgtggtacaagggatttatgcctataaattcttaaaatccttatggaatttagtggttaatctcggtgtgatggacgaaaacactattatgctagcagtgttaaatcttattgacgtggtaatgattgcaaacctattaattatggtgattgtcgggggatatgaaacctttgtatcacgcttaaatgttgataaccacccagaccagccggaatggctcgatcacgtgaatgcttctgtgctaaaagtgaagctctcaatggcgattatcagtatttcatctattcacttactgcaaacatttatcaacgctgcaaaattaagccctgaaacaatgatgtggcaattattaatccatatcggctttattttatcggcgattggcgtggcttatacggataaattattaaatagtgtcgcacacgcgaaacattagttagatgtttttaagtatacttgatataacttggctaggcatagtattgacagtattcctgaagtttgtctactatgctctatcctatctataccgatctaaaaaacgataataattcaccccaattttaagtgccatttgtttgacaagttttccgccaaataaacttggcactttcagggcttcaaaaatacgcaaacgctcgtcattgccctcaatggcttcggcgataatacgacctgcaagccctgttagtgcaacgccgtgacctgaaaagccgtgagcaaaataaacattagacttcactcgaccgaagtgaggtgaggcatttagagtcatatcaatcggcccaccccaaccataatcaattttgacatcttcaagttgagggaacacatcaagcatattacgacgcatttttgccatcatatcgacatttgaactggaatcgctaccaaagagtaagcggttatccgcactcaagcggtaataatcaagcaaaatattgttatcgcagacagacataccattattgataacactatccgccattgcttgagttaatggctcggtcgcaatgataaaactttccacaggaagaatttttcgagcaagtttgaaaccaatttttttattagatttagcgtcaatgtaggcatttgttgctaatacaacattatctgcggtaatagtgccttgtggagtaataactttaacttgtttacctgaaaattgcagatcaagggctggggtgtgttcgtaaattgtgcccccttgctctaaacaggctgcggctaaaccgagacaataatttagtggatgtaaatgtcctgattgactatcgtacaatgcaccacaataaattttactgcctaaatgttgctctaactttgccttatcccatagttgcatatgttgatagccaaatcgttcacggctctctttttcaattgcaactaaatcgtccattcgacgatgatttaacgcaagcgttgcatatcctttcttccagtcacattgaatgttgtaggttttgacacgctcgtcaataatgttgatcgcctcaagggacatattccaaagtttacgagcattttcttcgccaacttgttcaatatattcatcaatcccttcctcaaagccattgattgcttgtccaccattacgtcccgaagcaccatatccaacccttgcaccctcaacaacaatcacattcttacctttttctgctagctccaatgcggttgaaagacctaaaaagcctgcaccaattacgcaaacgtccgtagattgattgcttgaaagatgaggtaattgaaaatgaatattacgagtatcggaatagtatgtgcgaatatgttcttgatgtgcaaaagtcagcataaaaaccgttttaatgacactaaatgaaattaggaagttaatttgaaatggcacacccgagaggattcgaacctctgaccgctcggttcgtagccgagtactctatccagctgagctacgggtgcgtatttgaaaagaaacggtgttatttattttatcagcgaccattttatcctgatagataaaaataaaatggcgcacccgagaggattcgaacctctgaccgctcggttcgtagccgagtactctatccagctgagctacgggtgcgtgataaagtaaatggcggtgagagagggattcgaaccctcgatggagctttttaaccccatactcccttagcaggggagcgccttcagcctgctcggccatctcaccactcactgtgtctgtgggcgtgcatattactaggttctggaaatatgtcaaattatttttgcaaaaaaattaaaattacagaccgcttgcctagttactaatcaaaacggtgaatttataacatttcttacataaaggctaaacttttcatagggttagttttttttcataccaaattttattgatatagagcgtcacttttccaacaggagtttcaacttgaatttcatcatcaatttgtttgccaattaatgctcttgcaacgggggaatcaatcgaaatccattgttttgcaggatcaaattcatcacagcccacaatccgatactgcttgatttcaccctcttcattttctagttcaacccaagcaccgaaaaagactttgccttcttgagtagggtggtaatcgacaatttgtagtacttccaaacgtttggataaaaaacgtacacggcgatcgatctcacgcaaacggcgtttaccataaatatattccgcattttcactgcgatcacctaatgctgcagcctcagatactgcctgtgttaccttgggtctttcctctttccaaagatatttcagctcttggtctaatgcttgccaaccagaacgagtaatataatttgactttgccattagcttgcgaactccacaatgcccgtaacttttcctgcttcattgaccgctattaatgagtgaatatgtttctctttcatatactcttctgcgtgagcaaggaaagtgctatctaaaatcgtttttggattacagctcataatctcttgagccgttttattcaggctttctgcaccaaatttagcaagtgtacgacgaatatcaccatcggtaataatacccagcaattgctcattttccataacaatagctacccccattcgtccttcattcattacattcaagcaatcgctaaaactacaaagcggacagataataggcaattttttctgcataacatcacgcacacgacaaagcaactttctaccaaggctgccaccagggtggaaacgagcaaagtcttccgctttaaaatctcgagctttaatcagagcaatcgctaagacatcgcccaatgccatagtcactaaacttgaggtcgtcggggcaagattatttggacaggcctcacgctcaatactaatatcaagggttatatctgcgtgacgagccaatgttgattgcagatttcccgtcattgcaataatcttattcccaaaatttttcaaacttggaatcagtttatttacatcatcagtttcaccgctgtaagagattaaaatcactacatcaatcggtttcaacatacctaaatcgccgtgaaaggcttccgttgggtgtaaaaagaaacttggtgtgcctgttgaagcaaaggttgcaaccattttcttaccaactaatcctgacttaccaatacctgcaactacaactcgtccttcgcagtttaatatcatatcaacggcttgattaaaggcttcagataagtgttgattgaggcgagaaatagcttgtgtataaagatgtagagcttcatttgcaattggaagatggttcataacatatcctagctaaaataaaatattgagcgaattatacgctagtttaagaaaataagcctatctaatctccatgaaattatatagtcgttctgctcttgatttatctattttctcaagttgagatagtgctgttttttgcttctcaatatccttcttcatattggcacataaggcgatattttctagtgtatctgcttgattgtaataggcttcttgactggttaatgccgtttcaaattgctgataagctttgtcgaactgtttttgtttgcacagaaaggtaccgtagttattcaatacatcagggcgaacttgattgtttttgctctgtgttttacttaacttcaaggcttgctggtaggcttcttctgctttttggttatcgccagtttgttggtaataataggcaagcacagagtgcggtaggtagtcttttacatcatgttcaagcgctttgtcaatgttctctttcgcttttggaaaatcagattgttcaaggtaagcaagagccaaattaatacgagctttgacggcttctgaacggttaaaatccacctttgcggtttgatttgtacaagcaacaagccataacgccacgctacaagcggtcaaattacggaaaaattttgcgaaggtcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattgattttgaaccgcaatcccttcgccgaatttacgtttttcaaaggtgcgtttagtgcggtcaatcacatcacctgcaagttgcccacaggcagcatcaatatcatcaccacgagttttacgcactgtcaccgtaaagccatattccatcaaggttttttggaagcgatcaatacgcgtatttgaactcttcgcataaggtgcttctgggaacgggttccacgggatcaagttgattttacttggggtatttttcaatacatctgccaactgatgagcgtgttccacatcatcattgacgtggcttagcatcacatattcaatcgtcactttaccgtgattagcgtttgatacttctaagtatttattcactgaatcaattaacgttttaatgttgtattttttattcagtggaattaattcattacgcagttcatcgtttggtgcgtgcaatgaaatcgctaatgcaacatcaatctgctcacgcattttatctaacgctggtacaacccctgatgttgaaagagtcacacggcgtttagatagaccataagcaaaatcatctaacataatttccattgctggaataacgttattcatattcaacaatggttcacccattcccatcatcaccacattggtaatcggacgaatgcccgttacaccaaagttaccgataatttttgatgcacgccacacctgcccgataatttcagatacgcttaaattacggttaaagccttgctgtgccgttgaacagaaagtacaagccaaggcacaacccacctgcgaagaaacacacaaggtggcacgatcatcttctgggatatataccgtttcaatttgctgatcgccaacccacatcgcccatttgattgtgccgtcggcagaacgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcaggtgctttaatctcagcgatccgttttaatttttcacgcaacaccttattgatgttggtcatattatcaaaattatcttcaccaaaatgataaatccatttcatcagctgatcagcacgaaatggtttctcgcccatttccgcaaacagttcacgcatctgctgacggtttaagtttaataagttaattttttcagttttggttgaattgcaacttgcatcggttgcttgaatttgttcagacattgtttgaaagcctcgttgttacacggtttgtggcaaaaggttagttttgctggaatttagttaaattaaaggtggcaattctactgttgtctgctcatttaggctagtgatttttacaagatttgaaaagttgaaataatgaatttttcgacggggatcacaaaaatagttcggcttgcgataaacaagccgatattcacttaaatgctcgcaatttgctcaaatgtttttggcgatttttcaaccatttttaatagtaagaccgcttgcggattgggctttgttcttccttgctcccagccttgataagttctcaccgaagtgtgtaatttacgagcaaaaacggcttgtgaaagatttaatttctgacgaatagctttcacttcttcgggggtaatcactatcggatcaggaacttccacaacagtggtttttagtgtaattttgccttgtaagtgtaactctaatgcttgcatcccttccattagttcattaaataattttcccatatattacctcactaaagattttaaatagcttaatgtattcgccaaaaccacacgttcttcattagataaatcgtcttgttggtttttattgtaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagattaccctagctccgcctctttttcctttttgtctaataatatccacaatacgcaattttcttagtcccccagtaccttgaataagctctcccttatcgggaaattttagtaactcattttgtaataatctaaatgagtcatcgtcaagatacttttttctatattcctcaaaaggcggcaactccacaaaagcgacattcattattctactcctatttttaagttaaatatacgtttaaaacgtatagttttagggaaaaacagaaaaagcctaattgaaatataaaaaagagaaaggacaagagataaatttttcgacagagatcgaaaaaatagtaaaaagtcaaagataagcggtcagatcaaacaaaaaatttgcaaaataagaaggagattgatgaaaagtgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcgttgtggggtggcattatagagttcaaaaattttcagtcaatccatttttgctattttttggctattcgttgaaaaattcacctaaactgtcaacttttcactatgatttccgctcaagaggggtaaaataccgaaacctttttgtttagaaaattctgaaaaaatataggcgataatatgaaaattgaaacccttttccctttagatccaaatgtgaaggtgcgtactcgtttcgcaccaagtccgacaggctatttacatgttggtggagctagaacagcactttattcttggttatatgctaaacataacaacggcgaatttgtattacgcattgaagataccgacctcgagcgttctaccccagaagcaaccgcagcgattatcgaaggcatggaatggcttaacttagcgtgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtttttagctgatcgataacaggcactttaaagtgtaaacctggttcatacacaatcactttattatcggcatcacgatgcactttgttgaaacgcaacataatgcctcgctgaccttcttgtactacgacaaccgattggaaaaggataaatgcaacaacggatagcacaggtaaaagtaatttacgcattcttaaaatctccctttacgcacaggctcactctgttccaccgctggcaattgtgccgggctgacaggttgagcaagttgtggctgttgttgaataacaggttgtgatgatggtgtttttaccgcttcatttgtcgttgatttagccatcaatctatcaacaggtaacaccgttagattattgccgtttgagctatctaccattaacttcggtgtatttttcatcactttttccattgtttgaatatacaagcggtcacgagtgacttctggtgcggctttatattcaggcaataattgagtaaagcgttgtacttcacctcgagcatttaacacaacttgctctttgtaggcatttgcttgctctaaaatacgttgtgcttgaccacgagcaattggctcttgccctcttgcgtaggcttcggcttcacgaattaaacgctgttcatcttcttgagctttgattgcatcatcaaatgccgcttttacttcttctggtggacgtgcgtattggaagttcacgtcagtgatcaataatcccatatcataatttttgataatatcacgcaaagcattccacgttttttcacgcacaatcgcacgccctgtggttagaatgtcgtccattgtcatatgtccgatcacataacgcaatgcactgtcagtcgcttgtttcaagctatcatcaggtttggtcacgctaaagagatatttcgctggatcttcaatacggtattgaacggtcatttctaccaacaccatattttcatcttgggtaagcatagagccgttagttctcagttctaacacacgttcaatattcactggcgttacattatcaataaaagttggtttccagtttagaccaggtaaaacaatttcgtgtaatttaccgaaacgagtaactacaccacgttctgcctcttggacggtataaaaccctgaagctccccatacaactaagcctaagccgagtaatacaggtaaaaattttcctgcagaaacagctggacggttattttggtttgagccattgcctctaccaccacccatttttttcaataaactattaaaaacttcttctaaatcaggtggttgcggttcatttgattgcttattaggccctttttcttgacccgaaggttgttcttgttcaggcttcttttgccccggtttaccccaaggatcttgctgattgcctgattcgttccacgacataacgttctccaaagttaaatttttcttcgcaaatgttaataaaatgcaagcgtttgattgtacctatttacaaaacttttggctagattgaatgtgtaaattattttatcgtcacttatcaatatataacgtacaataaaaaatatcggatatatgtttgctcctattcaatataatgaaaaaacatgactaaaatcagcctagtttaaatatgtgaaagataattaatgaataagagaggaaaaatgtataagcacctttggctttctaatttttttggtcgaaatatcgctgatctggatcttattagtaaagggagcaactcggatttagttctcgctgatttctctctcattcaaacaaaattgccaagctgggcaataacggaaatagcttgggtgcagcagcaagattttcagtttgtagaaggtgagattgtttttgaatatgatcttgcacatttttcacctgaactgaccgcttgtcgtgtggcaacggaacaggatttggttcaacttgaacccttttcgcatttgttttcacaaacgcgttttcgttcgccttggttttcattgttagaaaatcgtcgattttattggcaatggattaaaaatgcagttaagggagaatttgacgatatttgtttactcagtgaagccacaagcggtgaaatacaagggatgattacccttcgagtaaaagagactacggcacatattggcttgttggcggtcgcagaaaaatggcggaagcagggggttagctatcgcttattaatgaatgcgatcgcttgggcgaaacgtcagcaagcgacgaaaatggtgattaccacccagctgagcaatttagctgcaattcggctttatcaacgcttaaacggaaaaatcagcggcacttattattggttttatcgatgatgcaaaacattccttttaaccaaccgcctgtattaggtacagagctaaattatatccagcaagcgatctgttcagataagctatctggagatggtcactttacccgtctatgtgagcaattgcttgaacaacggtttcacgcccataaagtgttactgacaccttcttgtacggcggcgctagaaatggcagcgattttacttgatattcaatcgggtgatgaagtgattatgccaagctatacctttgtttctacggcaaatgcctttgcactgcgtggggcgaaaatcgtgtttgtagatgttcgaccggatacgatgaatatcgatgaagccttgatagaacaagcgattacccccaaaacgaaggtaattgtccctgtacattatgcgggtgtggcgtgtgaaatggatagcattatggcattggcacagaaatatcgcttatgggtggtagaagatgcggctcaagggattaatgcgttttataaagggaaagcacttggcacgattgggcatattggctgttacagtttccacgaaacgaaaaatatcaccgcagggggagaaggcggggcgattgtcattaatcagcctgaactgaccgctcgtgctgaaattattcgagaaaaaggcacagatcgtcagcaattttttcgtggcgaagtagataagtatagttggcgagatctcggctcaagttttttaatgtcagaaatacaagcggcttacctttatgctcagttacaagggttagaacaaatccaacaaaaacggcagatgatttggcaatgttattttgacgcattacagcctttggcagagaaagggattgtggaattgccctacattccccaagagtgccaagcaaatgcccatctgttttatataaaatggaaaaatctcaaggtgcgaacggattttattaatgcaatgaaatcaaaaggaattttgacggtcttccattatgtgccattatattcaagccctgcagggcagcagtttggccgattttgtggagaagacaaatggacgactaaagagagcgagcggttagtgagattgccactgttttttaatatgcaaaatgaaagtattgaacatgtaattagggcaatattgttttggaaatcctgatatattctcttaaaggaatgtctcaggatttgagctagggtgaagactttttctttataccatcgcaattaggttatatagaaaattctgcaaaatcacaccgcttatatttgtcgatattctacacctgccacgaaataaacgcccaacgggcttgatcgtggctgattttttgttgagattgctgtttttgctgatagaaagcctgtaatttttgtcgttctagttcggttaatgtccctagcgaaaactctacggcattttgcagatcttggtatgtttccccttgaaagccccctgtttctccctgtaaaaagtcagttatgcctgaataccacgctgataaagacggtttaacagatagatataaaaggcgtaaacttgtttgcataaacgggctaggggaatggcaagcgttcccggctctgagccaatatccaatacgctatctgttggttcaatcttcattttatctagaaattgacgggaataactgttctctttttcaacaaaagtttcggcaaatctaaccgctttcttatcccatttctcagcggtaacatcatgataacgacatgcaatcagatgttgtttataaagttgagcaaaatcaatgtcgtagaatgaattcatgttattccttaaaaggtaaatgttgagccaaactcgccatatcaatacgataggttttggctaattgatgaagagtaagcatatcggcttttttcccttgttgaaaggctggctgatgttgtttatctaaaatcacaacgctatctgcaaggtaatcggcgtgctgtaaagggaaataaactttgatgcgcttgcggcacataggcaatttgttgggctaactgttgtggtgaataggtaacaagcggttggtttgcaaagaaaatttccccgtgcaattttgcttgagtacccaataacgtacgtaaaaaggtactttccctgccccatttgcccctaacacacagcagatgtcatttgttcccagacgaaaatcgatccctgagatcaaaggctgactggcatagccaatcgttaggtttttcgtttccagtatcacagttaccaacaataccgcactaataccgccgacaaatgcaaaaagttgcacataccacatcggcaaattgcaaaaaatcgccaacgaagcccccaaaccagcccctaccgatacacctaaaatatcgggagaaaccaacgggtttttaaacatcccctgatagattgcccctgcacaagctagtgcagccccgactaagcaagcaacaataatccgtggtactcgaatatgccataacaccgtttgaatttggttggtttcgcattcaacagagaaagcacaaacgaccgcttgccacactgctgttggcgaaatcggatactttccgagattaagcgaaaacaaaatagccagtaataagagcaaactcaatatcagtaaattgcgtaaaaatgatgtcagggttccattgcaaaagctgttccatttaattttttgtacatgctcagctttgggtaaattgccaaaatgggtactgatcggctgctcattggcagacacaccacttgtcacaaacgccaataaagcgaatgcagaaagaaattttttcataatctagcttctgtgattaagacaaaatcattatatttaaaattatatagcgatagaaattgatcaacaagtcaatacattatgtaaatttttgcaaaaaatgaatgatcgttcagtttagagctagtcgaaatggggcgttttctttaaaatacgccccatcattttttaatcaaggaatttctaatgaaagtgtcaaaacttacttttacattactttctgcactggtactttcagcttgtaccaatatgagcaacgatggctctctacaaaaagcacagcaagattatcaacaatatcaagacattacgaaacaatatcaaatcaatgagcaatggtggcttggctataatgatacccagcttaaccgcttagttgaaacggcacttgccaataatatcaatttggcaaaaacggcaatttccgtgaataaagccttatataatgcaaacttagtgggggcaaatttagtcccaactttcactgcttcggaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcttctgcttcaaaaggtgttggttctagcagtaacctaaactcgactggcacatcaagtattggacatcaaattggcttaaacctaagttatacccttgatttatgggggcgtttaagagataccgcaagtgcggcagagtgggaacacaaagctacccaaaaagatttacaagcggcgagattatctttaattaatgccgttgtgagtagctattacaatcttgcctattatcaagacgcaatccgcattactcaacaaagcataaaaagctatgagcagatcaaccgcattttaagcaataaattcaaacagggattaatcgaccagcttagcgtagatcaatcaatgcaagcggtactttctgcacaaaataccttaatcaacttacaatcggctcaaaaatccagtgagcaagttttgcgtaatttgctaaatttaaaaccgaacgaaccgcttgtagtcaattatccgagtattcttaaggtcaaattacaagatgttgatgtgaatgttcctgtttcaaccattgctaatcgcccagatgtactggcaagcttacagcgtttacaaggggcatttaaaaaccttactgcaactgaaaatagctggttcccaacggtcacgttagggggaagcctaacaggaagttcgacgaagtttaacaatacgtcagataaccctgtcgctggtggcgtagtgtcttttgatttgccgttcttagattggaacagagtacaaaataacattaagatttcagaagagggttataagctggctaaattgaactatgaacagacagtaacaaccgcattaaatgaaatcgacacctactattccacttaccaactgtcaaaaagtggctatgcgaatttacagaaaaaatatgagtacgatagaaaaatcagcggatattataaaaaccgctacgatcaaggtatctctgaattgcgtgaatggctaagtgcaatgaacaccgaacgtagctcagagctttcgttgcttgaaaataaatataccctgctcaaaaatgagaatgccatttatcaggcaatggctgggaaatatcgcaaatagtatatttaagtataatagcagtgagaaattaagctgcgcctctaatttctcaccttttactacattctagcctttaaatcgggaaacccacccaaatccttcaacttattcaccattgcacaaaacagctctgcagtgcgttccgtatcgtacaaggcagaatgggcttgtttgccgtcaaaaggaatttgtgccatttggcaggctttgactaagaccgtttgtccatacataaaaccagccaaggttgcagtatcaaacattgcaaaagggtggaacggatctcgtttggcattaatgcgttttaccgccgcttgtagaaatgcctgatcaaaagttgcattgtgtgccacaatcacagcacgttggcagccgttgtcttttaccgctttgcgtaccattttaaacatctcggtaatggcaatatcttctggcacagcaccacgctctgcattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggcacagcaccacgctctgcattatctacatcaattccatttacttttaatgcctctggattgatattggcattttcaaaaggtttaacgtggcgatgaaatttttcatctaaatgcaaatagccatcgtcgtccatttttagtgtaatcgccgcaatttctaacaatgcgtccgtttgagcatttaatccccccgtttcgacatcaaccacaacaggaagatagccacgaaagcgatttttcaatagattgtaattggttgcttctgtttcagccattaacctaacgccttttgtgcatctttgttagcgatgaattcgattttgtaaccgtcaggatcttccacaaacgcaatcacggttctaccacctaacacaggaccagcctcacgagtgacttttccaccagcttgacgaaccgcttcaaccgttgcgtaaatatcatctaccccnnnnnnnnnnnnnccataggcagtgcctaattcatagctctcaactccccagttatacgtcagctcaagcacggcactttcgctttcatctgcatagcctaaaaatgcaagggtatatttatattgctcattctcgctggtgcgtaataaacgcataccaagcacttctgtgtaaaatttgatagaacgttctaggtttcctactcgcaacattgtatgtaaaattcgcatcgtaaaatcctcttaaaaatagaaaaaagtgccaatattatggcataatctcgccctaaaatcatttttgaattgaaactatggctcacgatcacgatacaccttctaaattagaaatcgccacgcacgctattttgccgttggtgacgatgttattgattgaaatgtcactcaatcactattttgcaccacaaaatgcaatctttgtttcgccttatctgctcaccttttttagcgtttgtttgattagcttcgtggtgctgtggaaagggcaaatttgcccagggcaaaaagggcgtttaacggctattctgccttggttcttggtctttgcggtgggtaattttctctattctcttgtctttaccccgaagcattcgcctgcattagtcgctggatttgcttctgttattctgccgtttatctattggaaattacctaaagataaagagatttatcgtacggtaatttattgtggcttaggcatcaccgccattggtatgctgcaatatttgctgatttattggtatgaagtaccgtcgctgtttaactggattagagccaataattttgctcagattttactcggtattttattaagcggttggtatttaatgctagcgaaaagccgtttggaaggctttttaaaactgttggtattgttagcacttatggtattaatcatcaactatgtttgggtgattttcgtgttatatcaacaacttgcgattatgcctgagatggtgatttatccttactttatcttctttggggttcagtttgtgattttgatgatgttagcttggttgctactcggtaaacagggaaaaaacatcaaaaatccaaccgcttggacggtcgctaccttccttgcaatgctttatcctttgacaaatattctctaaatgttacgcagaagtttattgattatcggtgcagtacttgccattttaatggctggtggtgcatcattgctttcaggctctcaattagcttctgcgattaatttgtcattgccaacgggctggaaaatagaaacacccgatggcattgagccacatttagaaaaagccatcttgccacaatttaccctttactatcaaaattgtccgattgtttcggcagatcgccttgcggtgcaatggattgatgaacggagtattcgtcttaatcaagcaaccattgattatgcctgcttaacgctttttcctaaatcggaaaaaagccaaaccgatcccacagaaaccattaaaacgatctttgcgttattgccagaaggtagcctagaaatccaatctttagcgtggaaaaatcttcccgatgaaatgcacgaacgtttgaaagggttactgcaatcacctagtgaaatcaaatttgcattttttcagcaaaaactgaccgcttatattaagcaacaagcggtcacattagatgcgaattttgcaaatcagcaactcagtgcacaacttagctatcagccgaataaggatgagcaacatcttgcaacactttctgcacagctagatgaacattttttagcgttgccccaacaactgagtttaaattatcaatggaatttgcctaaaaccttgatcgctgaaccaagtttgcaacaaggtcattcaacgctcagctggcataaacaagatcagcaacttcacggaaattggcaactacattccgctataacacctgaaaatcaattcaacttgccgtttcgttttgatacacaaagcctgacgattgaaaaagggaaaattgattggcaactctcaaatgattttccgctcaatgcgtatctgaccaccaccattaccccaaaccgtttttctttagatgagctttatccgataaaaacggcggttcgtatcagtctgcttactcaaaatgccaaagggaaaggcaatgtggtgatcagtagtccacaaggggaaattcaacaagatagnnnnnnnnnnnnnnnnnnnnnnnnnnnnnnnnnnnnnnnnnnnnnnnnnattttatatagcactattcctttagatttacggggaaaatttgatgatctcaccttacgctttttacaaggtgcgttgctacgtctaacggggactgaacgttttctcaccatcaacgatttacgttttcccctggcgggcgtgcgggtcgataaacaaggtattcacgggcgtttgcaagcgattttccgtggtgaaagcccagactttaaaaatatcgaaatgcggttggacggttacgctaacaatttcaaagcaggggcgttacactttttccaagatccgaccgataaaaaagcggtgaaagatcaatggaattggcgtttttggggcagtttgcaaataaaagccttaaaccgaccgcttgcaatatcagggcgtggtttgtggcataaagatttagtgcaactgtctgaatttaaaggaagtctggagcatattcggaaaaatggggtatttattcccaaaacagagctggtattaaatgaaccaataaaatttgattatgagaaatttcatctnnnnnnnnnnnnnnnnnnnnnnnnnnnnnnnnnnnnnnnngcctatggtggcactttagaaaaaccaacagctaacttaaaattttacggcgaagtagaaaatcttaactttaggggcgatgtgacggcgaataaactcggcccgattaagctctttgctcgccgaaaattaaccaataatgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattggtcggagcaacctgcaaatgtattccaaagcctttttccctttagaaatcaatgggtcatcacaaacggaaccattaaaggcgaaacggcatttagtgcgaatgcggctcgtgggctgatggctggcgggcattttgctattcgcaacggtgcagtttctctaccaaacggtgagatcaagggcattgatttctcactcccttatcaatacaaacagggtgaagtggatatcggcgtgaaaaaagcccttgatgtgaatattgatgaagtgaatatgggtattccgataaccaatgttaaagtaaaaattcaagggcacttaccctacaccaagcgtaagcccctgtttttacgagagttaagtttaaatttgcttgatgggcgtttaaatatcgaacattttgccctgccacaaacgaaaatcgcttatttaaagctgtttgatattcgttttgaacgtattttagaattggcacagtatcaccaactggatttaactggcaaattcaacggtatctttccgttttggctgtcgggtaaaccttgctacatctgcaatggaacattgacacaagcggatagatcttacctaaaatttacccctgaattgcttgaagcgattaaacaagggggctatacggaacagattttggcttatatggtcaataaaagtgagattgacgatttcaccgcaacggtgaatttagacagtaaaggcgatatggatttatcagctaaaatccattctagattgactgagcataaacaagcgaaagtcaatttgaattataaccataaagagaatatgttcgacctgtggaaattgattaactacggttctcagtttgagcagaatattgagcactcaatctataaacaattagataaacaataaccgcactcagtacatgctaagggctcagaattatctaagccacttatttactagaaacttttctcaaaactcaaataaactcgatttcgtttatacgaataaagatccactaaatttgagttcactcgctgatattgatagctgattttcggtgtaattccccaaaaatgcaggttacgatgccaaagtgtaacattcaaacctaactctctatctttgcgtatctgattaaaaatgcggtgagcttggtcaaattcacgtttgccataactgagctgaatacggctggaaattccgccccaccattcttgcccccaaccaattcgccctgtataacgttttgaggctaaagaacgttctaacgtccgatctcgcaacaaatctacaccaccatagagataacttttcgcatcaaaggcatagagtagcgtagcagaaccaaataatgttgtgctatctgcaagctgattttcgccccgatgtttgagcttgcccatttcgccagccgtagaaagctgccattgtgatgtaagccaatgctctacttctccccgaacgccatagccgtgattatagcgatgattaccataccaacgcatttcataataaggcaaaaaagcaagacgactttgagcattttgatattgatagccaagacttgaacggttttgctgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagtggcaacgcctgattccatagctgcttttgcaactgctggggcaatgcgtacaattaaacgagggtcaaatggacgtgggataatataatccgcaccaaaggttgtcccctctccaccataggcagaagtgaccacctcattttgctctgcaagggctaaatcagcaatcgcataaaccgccgcacgtttcatctcttcattgatcgttgttgcccctacgtctaaagcaccacggaaaatgaatgggaaacaaagtacgttattaacttggtttggatagtctgaacgacctgtacaaacaatcgcatctggacgagcagctttcgcttccggcggtgtaatttctggatttggattagctaatgctaagataatcgggtgagccgccattgttctaaccatatcctgcgttaaagcacccgccgcagaacagcctaagaaaatatctgcatttggcatcgcatcgcctaatgtccgccagccattatcatcaatcgaataatgtttcttggtgtcgtccatacgatcgtcacgatctttatagatcaccccttttgagtcgcagacaacgatattttcacgcttcatacctaaggatacaagcaagttcaagcaagcaatagaagccgcccctgcacctgatgcaactaaacgcacctcttcaatttttttatccacaatacgcaacgcattaatcactgctgccgcactgatgattgcagtaccgtgctgatcatcgtggaatacaggaatgttcaatcgttcacgcaatttttgttcgatataaaaacattctggtgctttaatatcttcaagattgataccaccaaaggtaggttcaagagaagcgataatttcaactaatttttcaggatctttctcattaatttcgatgtcaaatacatcaattcctgcaaatttcttaaacagaacgcccttcccttccatcacaggcttacctgctaatgcaccgatattgcctaaacctaacacggcagttccgtttgaaatcacggcaactaagttaccttttgaagtataacgataggcagccgctgggtctttttcaatttctaaacacggctcagcaacccctggcgaataagctaatgcaagatcacgttgcgttgcgagggatttagtcggggtaacttcaattttaccagggataggaaattcgtggaaatcaagtgctgcttggcgtaattgagatttgtcatccatagttgtgtcctttatacaattgaataaatgaaatcatcagtattctacctaaattttgggaggaatattgtgatatagctctaattttttaacaaataattaaaaagtatagaaaggaataatctctaattaaatgagacgtttaatcatgatgccaaaattaagtattatttgaaataagtattatagagcgatactatgatcagtaattgaaagaaaatcaagaagttaattgagggcagagctgttttatacaacaagctctgcaaaataatgtgattgttagacgctatagagaatatttttttgcagtatctttcaacaaggtctgcaattcacctttttggaacatttcgagaacaatatcacaaccaccaattaattctccatctacccataattgaggaaatgttggccaatttgcgtattttggtaattcagctcgaatatctggattcgataaaacatcaacatacccaaatggaacttggcaatttacaatagcttctgaagcacgagcagaaaagccacaggatgggaatttaggagagcctttcatataaagaagaatgggattctcgctgatttgtttttggattttttctatagtttccatgtttttcctcattgatcaataagaatatgtaccctattctaatgtgaaacagaattttctgcaatttgccattaacatcttctaaagtatttctgtggattatagtccacttattccaaatcatttcattaaaatatctgccaatatttgttcttttaatccactttgtcgttgaatttctgcttttactgcttgtttccaaattttttcttcactaaacaaggtaaactgttttttagcacgggtaatcgccgtataaatcagttcttttgttaatactggcgaatgagaaagtggcattaccaataaagtatgatcaaattcagaaccttgtgatttatgcacggtcattacataggcgggttcataacttggcaaacgactaagggaaatgtctaaatattttccattttgttctgtttcaaaatatactctcaatcttcctgcttcatctggaagaattaagccaatatcaccactaaagatatgaagttgaggggcattttcggtaatcaaaattggcttgccaatgtagctgtctcggctatgtttaaaatgtaataaacgtgcttgtaataaggcttctgcaatggtttgatttaatcgttctacgcccaattcactgacgcgtaaggctgacaaaaagcgtacttgttggaatgctttaaatatctcaccgatagacacggcttctggggaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactcgagctttcactttgttcaagtaatcggaatataactccaccgctttttctaccacgctatttacacagtgttgtatccattgtgatttttcaggaaaatccgtgactttagggtaacacgctaatgttaaatcatcataaaccctattcgttaaaatctgccacgatttcaccgcttgttgggtgttcacttgtttagctaactgcccaatccctgaattttcgtcaaaacgaaaacttcgacgaagatgacataatgaattacaaattgcggggacattttccactgtaggataaatttgatgttctgttacctcagttagatagtcactatgctcattgctataaccaaatctgatcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttctacagaagcaagttgatctttatccccaagcataatcaaacgggtatctggttttaaggcattcaacagtttttccagtatgaagagatcgatcattgacgcttcgtccacgactaacagatctaaatgcagtggattttgagcgtgatgacgaggtagatcactatggggattaatgccgattaacgaatggattgttgaggctctggttggtacttctgctttcaaactgtcaggaatatcaaggctagcgagattatttgaaatagcttcttttaaacgagcggcagcttttcctgtcggagcagcaagggcaatcttaaaaagcggttggttctgttttaactgtttaagctgtaatgctgcaagtaaaatggcaactgttcgggttttgcctgtacctggaccgcctgaaatcagacagaagcgtttagttaatgccgttgcaacagcaactttttgccaatccgtgtcagcttgttttggaaaaaagcgttgtagaatttgacgatgaagatcgatatctgctttttttaaatccaaacttaccgcgtgttgtaaatagtgtgctatacgatactctgcctgccaatagcgataaaaatacagccgcccctgttgaaataataaaggggcaacctgtgtaggatcttggctaaaagcaatatggttatgtagcaacgactgccacttaagcggtgaaattccctcaattttttgcaaaatctccgtatgaaaatcactgctgaaattctttttttgcaagccaaaaggattggttgttaaatcagaatttaaacgaacacaactatgtccttgcatcacattaaaagaaactaatgcactcagaaagatagctaaattctgctgttgagctgtatagttataatcctgctgtttctgatcaatcatctttgcaaattgatagtttaattcagaaatcacattctccgtttttaaggcataaagtagaggtaacataagcaaaaatttgataggaattgatggaagcagtatataaaaaaatccacgcatttgcgtggattttttaagataatatttgttaaaaatcagaactgataagacgcgttcaatttaatattgcgcccagccccttccattaagctaaatgcaggttggaactttttgtcaaagacattctcgatcatcatatctaaacgtaaattacgccattcgccagaaggtgtgtaacttgcttttaaatctgtgagagtataacttggataagtcattgcatgtgttttaggtacacgtttctgacttgcatagtgagtgatattagctccaatcataaatgtttgaggcactaacgcataatcaatagtaaagcctaatttattcgctggaatattggataaggcttcctgtgtttggcgatttttgccttttgtttgagcataattcaatcccaatgctaaacgttcttgctggtaagcgaattctagttcataccctgttaagcgagcattttctacatttcgatactgcgagagagatggaatcatatctctttgtgaagctcggaaaatatcaagatgaataaaatcttttacatcattttggaaataagcggcattgaatatgaatttatcttgatgtacaaagagattatcaaaatgaactttcgccgcaatttctttatttttcgcagtttctgggcgcaagtttggattacttacaaaggtattattaaatgatcgtcccattaaatttgtgccaaagtgagacccgctgacaaagcgttcttgcattgatggtgtacggaatgctttattataacgagtactaagatctagccaatttgttgctttccaagttgcagcgatggatggagaccaacggcttgcactatatttggcttcgtcactttgtgttttaaagtgatcgtagcgaacacttggcgagacaataatgcgttcattccataatggaatatgtgttaaaagataaaatgcactgtttttagatttagcgtcataattattagggcggaatggtgttgtggcatttttctcacgctgtgttactactcggtctgaaataaaatctacaccatagtttagggctaaccaatttagatccgtcgaatttcgtatgtttaaacccatagtgctgagtttagtttgatcttgcaaaccgcttgcaatacgctgctctttttcttttgtactgttacggtatagcgtcaattgactattgatataatcattgtctttagggttaaagtaatagtgtaaggcactactttggtctgtgattttttgtttagctcgataacttacacttcctagtactgatgtgagtcctttatagaaacgagtcatttcagcaaaagaagctgttggattatttctatgccagtttctaataaggtttctcacatcttggttggtaaattcttcagcaacttcattgttggttggggcaatttgttcaaaatgacttaaacgatgagaaagctcaaggcgattttcatcattaatttgccaaccaaatttaaaaagtccgcctttttgagtatagcgactgtctattaattttttactgtccgctaaacgtaaatcatcagcgtggttataaaagccactcactaatccatcaaacttgtcatttgcggcaaagacactgacatctgtttcagagagagaattggcagattggtatccttgatgaatttttgctccaatttgctgattatctttcaataaatcaagtgcatttggtgttctgatcgcaacaattcctcctaatgcaccacttccccataaagtacttgtagggcctttaatcacctctatttcttgggttagtgccataggtaaaaaatatgaaccacggtgagataagtcaaaattctggcgaacgccatcaatcacttgaacaacacgattaccacttaagccccgaataatcggcttttgtgcaattccccttgatccgccagcaatatccacgtttgtaatccttttaatcgcatccgctgtacttatgggttgttgagttaataattggtttttatttagggttgctttctcacttgtgtgatttgcccaatgaaatgcatccctacttgcaatcacagagatttcagcgagctcagctgaaacattgctatctgcaagggatacggtaggcaaagagagaaagagtgctgtataaatttttgatagtctcattttagttgctcctttagtctgactaataaatatcctacaaaagataatgtaaattatcaataatgatattgataattcttatcatttagttaaaaataaatagaaaaagcgttctaatacattattaataaaggagacctatcaaaatgaaacattttcatagaaaaaatgtaattactggaatcattctttcatgtgtatctggctttacttatgcaaatccaataccagattcaggaacattgaacaaacagttggaacagacacgccagatacaagcagcaaaagtaaaaccctctggtgagctgttcaaaacaccaacacgagaagagaatcttccagccaacaaagaaagtcttaaattccgtttagattcagtgaaattgcttgagttggacggaaatgaaattaaagataatctgacatctattacctctccttatcttcatcaagaaatcaccttagatgacttaaatcggttatcgcaacaaattactaactactatcgtgataataattatcttgttgctaaagcctttattccaccacaagaaattaataatggtgaattgcaaattttcgtgataaagggatcgcttgatcaggtagttgttagaaatggaagccgtttaaaagaagacttggttatgcggatggtgaatactactgtgaaaagccattcgtatttggttaaaaataaactagaaaagttagctctattacttaatgacattaaaggaattacctcagcgttatctttgaaagcaggacaaaatacgggtaaaacagatcttacggttaatcttaaagataataaacgttggaatggatatatttccattgataatcaaggaaatgataatactggaaaatatagaacaacattgggaaataaaatttataacttagttgggcttggtgatgaattacattttgatgtgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaaactatttaaaatataaattaggtgcgaattttaaagatcttaatgctcaagggagtacttataatttaggtggttatattactcaccctactattagaactgcaagtttaagattagatagtaaattagcatttaatcatcagaaattgtcagatgaacaaaaatctgttgatttacaacaaaaacggaaagtaaatacgactagcataggactgggtggttcttggaatagtataaaagaaggcgttacctatttttctttcaatactacttttgggaaagaaagtcattcgaccaatgagaaaaaacactatttatcagagaattaccagcctaaacgtacatttacgacatttaattattcattatctcacgagcagtttttacctaaatccttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgggcaattcgctgataaaaatctagatagtggcaataaattcctactaggtggattatcaggggtaaaaggatatcaagcaggtactgtttctgtcgatgaagggcatattatccaagcggaactaaaacattacttacctgttttctcaaaaagtatattagtaagctcactcttttatgatgagggttttggaaaacaatataaaaatactgagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggtgttggtttgaatttaattgaacctaatcattattctattaattttgcttatgcaaaacctatcggtaagaaatataacaatgtagataaaaatcaattttggttatctgcaattaaaacattttaattaaggagtacataaatgcgtaaacaaactttactttccgtagctatttcaacagcacttagcacaacaaatctttatgctgcagacttacctcaaaaccataaaattacagacggcaatgcaaaaattaataccttaaataaggcaatgaccattactcaagaatcacctagagtgagtattgagtgggaaagttttgatattggaaaacaaaatagtgttgaatttaagcagcctgattcaaccgctattgcttataatcgtgttatgggcggaaatgcaagtcaaatacaaggtaaattgcaagcaaatgggcgagtgtttctcgctaaccctaacggagttattataaccaaaggtgctcaagtaaatgtaggtagcttacttgctacaactaaggatcttgaaaaaattagtaatagtaataatttcaattttactccacgtaaaaatcataaaactgctgaaggaaaaattattaatgagggtaaaattgttgcaaatggcgaaaatgcatttgttgttttagttggaaatgatgttgaaaataaggggacaattgaagctaaatactttaaacaagagaaaaaagttaaaggtcgttattgtagtggttggagtgcaaatgattgttatgagggtaatcattggggatttaagtggattgattttgaacgtgatgaaactattgaaagccctggacaagttgtcttgggcgctggcggaaaatttagcttagaattagatacgacatctattgatttagatattgaagaaaatacagtaaatagtattgtgaaaaattcaggttctattattaccgaagatggttatattgagctaactgctaagggaaaaaatgaattaattaataaccttgtgaataacgatggcttattacaggcggataatgttgtaatgtctcgatctggaaaaataactttattttctgatgatattaaatttggaaaaaatagtgatattcaagccgaaaatttaacaataaaagcgaaaaagaatgaaattaacttaaatgctgaaaaaggtgcaaaacttacaattaaagatagtattgattttgcagtcagtagctatctagacccagctataaagaaagttaatcttagtggtgatttaagtcgggaagataaaaactattatgatgacggctctaaaaaactaaaaacaaaagttaatctaaagctggcagataatcttgatgttggtaataaaaaagtaggtgaaaattcttttatcagcagtaattttttaggttctttactgggtatttcaggagaagtaaatctaaatgcacataattttgatatttcaggtgatataaatatagactcatataaagatactgattcagttttattattaaatacacaattaaattatactaatcctagctatattcgttttaataaagcaaatatagatactaaaaatgggcgtttatttattgcaacagatctaatggataaacattttgcggataaaggcatttcagatattaagattatagatagtaaatttaattttaataatggtgctattgttttaggtagaaatggtttaagaagaaatttagaagattctagaacttgtattaatcttgcctattgtttagaagatactcaaagatcgccttttagtgtaaatattagtaatttgcagcttgataaagtagacgattttgtcattgttggtggctttaataatgttgatattgatcgtcttactcatataggaagaggtaatttctatatttatgggggatattcctataataaagaaaaaccaagctatgactatgcgattttcaataccaaagatagggcgttgcgtacagaacgaaatcatactcaaagacgatggaaattcaataataatttacgtcaatggattaataatgagttcctatatgcatttgattggtggactgccacaaataatagttatgacaaaattaaacaagaagttattaaaacacctaaaagtcatttagaaacgacaattaatattcgtaatagtaatataaaaacgcatgatggttttattaatcttatggcaaaaaatattaatttaaccgatagtcaatttaatgttacgtttgaccgaaatatgtcttttgaatctgattacgatcgtatccataaaattgggttaagtgcagataaaacgattttagatcacacgtcattaaatattcagggggctgaaaaactgaatgtttcaccaagttcaaaaatgaaagcggcaacaatgtatgtcgttggtgatttagaagggcgaaataaaagttcaattaacctgaaaagccatcaaggttatacgttgatgacagataaaaatgcaacattacgcggtgaaaaatcaaaaaatgatttaactattaccttgttaaatactggtcctaaaccttcacctgaaattggtattacaggttctgcggataatgatgcaaatgcagctaactttgctttagcccttggcgatgctacaaagactacaattgagaatgccacggttattgcactagctccaaatggtgctaaagcctattacagccataaagatatgcctatcgtgttgaaaaatactgattttacattttatgagcaaccgagaggaacaaactacggtgatgatgagctagccggagaaggaaatatcaaaagacttaatgagcgtcaattaaatacgatattagataaacttaacgggattaagccaacttatctatctcgcgaacagagtaatttagttgaaaataataagttcggagttaaatctctacaacctgaaacactagaagatgagaagagcgttgttgtctctatttgtgatgaaaacaataaatgtgaagatcgaattattggcaataaacataccgatgctaaagtttcggtaggtgaaattcgttagactaaatcgagaagacacaggtattggtttgttgaatacataaaaaaatccacgcatttgcgtggattttttgctaatgagtagaattattctacacgaagaatacgacaagtatttgtaccaccttcttttaactcatcaccatgagttaatagcactaaatcaccagacattaaatagccttgtgcttttaataaagataatgcttttttcgcaccttcaatagtacggctgtcatgttcataatgaactggcgttacaccacggtataatgcacaacgatttaacgcttgttcgttacgagaaagtgcatagatcggtaaaccagagctaatacggctcattaattttgcggtttcacctgaatgggttaatgcaatgattgcagaaacaccttcaaggtggtttgcggtgtacattgctgacatcgccgttgcttcatcaatgcttgcaaatttagcttccatacggtgacgtgaaacattgatgcttggcattgtttctgcacctaagcagacttctgccattgattttaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctgccattgattttaccgtttcaactggataatcaccgtttgccgtttcacctgaaagcattaccgcatcagtaccatctaatactgcgtttgctacgtccatcacttccgcacgggttggcataggctttttgatcattgattccatcatttgtgttgcggtaattacaacacggttcaatttgcgtgaacgacggataagttttttctgaacgccaactaatgctgcgtcaccgatttccacacctaagtcaccacgagccaccataataacgtctgcacctaaaatgatgtcgttcattgcttcttcagttgcaacggtttcagcacgctctactttagcgacaattttagtgtctaatcccgcttcttttgctaattgacgagcatagtttaaatctgcacttgattgtgggaaagataccgctaggtaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactttagcgccgtcaatagaaagcacttttaattgaacgttaccatcatctaataaaagaatatcgcctggaacgacatcgtttggtaggtttttatagtctaaaccaactgcttcttgatgaccttcgccttttggtaattctgcatctaaggtaaatttatcaccgatgtttaagaaaattttgccttctttgaaggtagaaacacggattttagggccttgtaagtcacctaaaatcgcaacgtgtttgcctaaacgttttgcaatttcacgcactttttctgcacgagagatatgatcttcaggcacaccgtgagaaaagttcatacgaaccatatttgcaccagcagcaatgattttttctaacgtattgccacgatctgtagctggacccattgtacaaacgattttggttcttctgagtttacgagacattattcaattactccattgtttaaattgtgaaaaatagaaatcttttatctgttgcttgcaacaacaaaaaacgccgtgcattatacgcctaaaagtgttctgtttaaaccacgaagaggataaaccgatgaatatttggataatgcgacacggcgaagcaggtttcaatgccccaactgatgcacagagaaacttaactgaacagggtaaattgatggtatatcaacaagggcaatggcttgcaaaaaggcttgaaaatcaacaaattaaattagataaagtgattattagcccctaccttcgcacacagcaaacggcacaagccgtagaacaaggtatgcaagcggtcaacactatgcaaagttttgcaaatcttgcggaaacatgggaagagattacccctgacggaaatcccgacacagtgattgattatcttgcatttctacgagaagagggagcgaagcatgtgctgattatctctcacttgccccttgtctttgacttagtctatcaactaacacagcagagagtacatttttctcctgcggttatagcagaaatatccaaggttgaagggaaaaaccatctgtccgttattgttcctagaaattcacaataaaccctaaaatgtgatcttagtcacaaaatacagttaacggtatctaaactaggaaattttcttattctatttaggggattctctcaaggagcaatgaaataattttcttaaaatttaaatatctttttaaaaatatcagaggaaattatgttttcatttttagctgaagttagacgcccagtcttagatctatccctagaagaaagacggaaaatgtggttcaaaccttttatgcaatcttatttagttgtatttatcggttatatggcaatgtacttgattcgtaagaatttcaacatcgcacaaaatgatatgatcgaaacttacggtttaactaaaacagatttaggccttattggcttaggtttttcaattgcttatggtattgggaaaaccgtagtctcttattatgctgatggtaaaaatacaaaacaatttgtaccatttatgcttattctttcagctatctgtatgcttggctttagtgctagtatgggaggagggagcattgcactgttcttaatgatttcattctatgcacttagtggctttttccaaagtacagggggatcatctagctactccacaattactaaatggacgcctagaaagaaacgaggaacatttttgggtttctggaatttatcacacaatgtaggtggtgcggcagctgctggagttgcattattcggagctaatgtcttctttaatggacatgtcattggaatgtttgtatttccatcaattattgcattaattattggatttataggattacgctatggttctgattctcctgaggcatatggtttaggtaaagcggaagaattatttggggaggaaattagtgaggaagatcgtaatactgaagaaaatcaactgaccaaatggcagatatttgttcaatatgtattaagaaataaagttatttggctactatgctttgctaacatttttctatatattgttcgtattggtattgatcagtggtccccagtatatgcctatcaagaattaggattttcaaaagatgctgctatttccggttttgctctatttgaagtcggggcattagtgggtacattcttatggggatatttatctgatttagcaaatggtcgtcgtgccttaaccgcttgtatcgccctaggtctgattgtttttactcttgagttctatcagtttgcaactaatgaatttatgtatttaacgacattgtttgctttaggctttttagtatttggtcctcaattactgattggcgtggctgctgttgggtttgttcctaaaaaagcaattgctgttgctgatggtgtaaaaggtacctttgcttacttaattggagatagttttgcaaaactaggattaggaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggacttttccaccgtattttttatagaaatacgctattattaattggaaggattttatgattcatgttgttcttattgatgatcatgtcattgtacgctctggtttttctcaacttctttctttagagagtgacgttactgttattggagaattttcttctgctaaagaagctcgtcaacatttaccttatttaaaacctcatgtatgtattattgatatttcaatgccagaactaaccacaaaattagtttcatctaaacagtctaatccggtagggcaattaacaaaaagagaaagggaaatttgtgagttattaatcttaggttttgaaccaaaggaaataggcgaaaaacttaatttgagttttaagacagtacatgttcatagatctaatgcaataaataaactcaatgtcaaaaataatgttgaattagcgaatttattaaattcacaactaaaatkatatttactacattatacacttggtttttgataacttgttcttatttctgcttatggataatctcagattatttactttcagatattgttttggcctgtctatttttgccgtttgccttacgtagtggtattatattgcatattcaacttaaattctggcctattgtatattgttctgaaattagtatattgattttattaaactatttatttccagaaatatatcaatattctatttttattttaagtatatgtagtatcccaattatttacttatcatatttatactatagtggaaatcaatggaaaaaattatcaattcaacttagcactatagtttcagttagtatgatcaatgctgtagtcatttcctcatcagaattttacttcacatttcttgtaagttttactggtggggtattgattgttcctgcttgctatttaatcaatgagtttttatttaagactgaatggcttcctcttacttcttctctaataaagaagccggtaactttaagaataaagcacatttttatttatattttactatttgttttaaatatctatattcaaatgaaattgccagataccttctataggtttgctttattctaccttgcaatccctattatattattagcttttcagtatggttggcaaggtgcatttttaggagtcctgcttaatagtatagcacttattggtactacacatagtttttctaatctcactatagctgatttattactatctatttcaacccaaactatcacaggaatatttctaggacttgcgattcaagatcagcgtaacttgaaccagagtttatcaatagaattaaataaaaatagattactcactcggcagctgattaatactgaagaaactattcgtcaagaaatctctagagaattacacgatgaggtcgggcaaaatattacagccattagaactcaagcaaatattttaaaaaggattgcacctgattatgaaaaaatatcaaccacaatagagcaattatctcttaatatttatgatacaacaaaagtactactaaatcgaattcgacctcgtctacttgatgatttagatttaccccaagctattgagaatctatttattgaactaaattttcaagataatcaaattgatactgaattaatatggaaaaatgatcaaaatttaaaattagaacatattctggaaattactatatatagattatgtcaagaaagtttgaataacattataaaatatgctaaagcaaataaggtaaaaatagaaattgaaataaaaaataatatacatattattattacagataacggggttggatttgatacatatcagatattaacaggatttggaattcgtggaatgcaagagagagtgaatattttatgtggtacatttgaaattatctctattcctattgaaaaaatccaattcaacatggaacaacacttaaagttaatttaccttacgtataaaaataatggaaaatcaaagtcataaaatttatcactactggcgactacatattatgataggaatgtatattggttatgctggcttctatttgactcggaaaagctttaattatgtcgttcctactctaattactgatttaggcattgataaaaataatatagggataatctcaacattattctacataacctatggtatttcaaaatttatttcaggtgtttacctagataaagaaaatcctaaacattttatggcttatggattatttcttacaggaatcacaaatatattatttggcctatctagctctgttctcatgtttactatattgtgggttattaatgcttggtttcaaggatggggatggccctcttgttctaagttactaacaacttggtattcaagaaatgaaagaggcttatggtggtctatttggaatactgcgcacaatgttggtggagcgatgatcccattaattattggttatctcaccttacattatagttggagatatggatttatcgccgctgggggcttagcaatattaatcagtatattcctattttttcgattacagaatactccagaaaccatgggattacctagcataggaaaatggcgcaatgataacttagagcttgctcaagagaaagagggtaaatatctcacatggaataagatcttacatcaatatgttttttttaataaatacatttggctattagcattaagttatgctcttgtttatgtggttagaactgccattaacgattggggaaatatttatttaactgaaaaatatcactatgatcttgtttctgctaatagcgcactttcactctttgaagtaggaggatttataggatctctagttgctggttggggatcagataaattattcgctagcaatcgtggtccaatggcattgttatttgctattggtatttttttctccattattgcaatgtggcttatgccaaaagaaaatttcatattacaagcaggaattttcttttcagtaggttttttcgtatttggtcctcaaatgcttattggtatggcagctgctgaatgttcccataaaaaaactccagcttcagcaacagggtttgtgggattatttgcatatttaggtgctgctatagctggttatcctttagcattagtgatggaatcacaccactggtctggattttttgtcgtgattgcttgtgcagcctctggcatcgcattattgctattgcctttccttaaagcacaaaattgacaaattacctatgagtaaataaagcaattagtattttgggataaagccgaatagaacaccgactcattcagtgatttggttaaagatacggataataaaaaagtggcttagtgccactttttattagaataattttctagaggtattaaagatttcttctttaaacggacgacgcatattagtgattgcatcaataatatcgtggtgaactaatttttcattttgaatacccacacaacgaccaccgtagccttgcatcaagagttctactgcataaacgcccatacgagaagctaaaatacggtcaaatgcacaaggcgcaccgccacgttgggtatggcctaacacagcagcacgggtttcgtggccaaagcgttcttcaatctctctcgctaattggtgtacatctgtcattaattctgtaatcgcaataattgcgtgacgttttcctttattgaaaccatcttcgatgttgcgtattagtgactctttatcaaaacctttttctggaatgataatgtattcacaaccgcctgctaatgccgcacttaaggttaaatcaccacagtggcgccccataatttcaacgatagaaatgcgttggtgagaagttgaagtatcacgcaagcggtcaattgcttctaatgcggtttcaagtgctgtttggaaaccgatagtgtaatccgtgcctgcaacgtcattatcaatagtgccaggtagaccgatacacgcaatgccgtgttcttcggtcaatagttttgcccccatataagagccgtcaccgccgataactactaacgcatcaatttcatattttttcaaggtttctacacattttgcacgcacttctggatttttaaattcagggaaacgtgcagaacctaagaatgtaccgccacggttgatcacttcagacactgaacggcgttcaagtttgataacacggtcgtgatataaaccgtaataaccgtcttgaataccatacacttctaaaccttcacttaaacccgcacgcacaacaccacggatcgctgcattcataccaggcgcatcgccgccactggttaatactgcaattttttttaccatatcaatacctataaatttaattttaaaaaataaatcaaaaaacttgcaaagattaccctataacgccctttcgttctagcagaaaatcgggaaatttacgattttttgatctaagttgagattaattttctaaaatgtcgagagcaaaatctaatgcggtaaaaaagcggtcaagatccgattgaacattgtaatgagcaagagatattctcaaggtgccattttgcgctaaataacgtaagtagggtttggcgcaatgttcgccactacgcaaagcgatctgctgctcggctaaaatcgccgcaatatctgcgtgatgttgatgatgaaagacaaagctaatcgttgggcttaaacacccttccgctaaaatacggatattgggataagtcgctaaccgctggcgagcttctttcgcaagctgataaagcggtgagtttaaagctgaaaaatcccatttttccaaccactccagcacctcaccaaaagcgataattcctgcgatatttggtgtacctgcttctaaacgataaggcaatgttgccatcgtgagcttttgctcagtaatctcttgtaacatttttccgccaaataaaagagggcggagttgctcaaggctactcaatttccctgttaatacgccaaccccagttggtccgtacatcttatgtgcagagaacgcatagaaatcggcatcaagtgcttgtacatcaatttgttcacaacagaccgcttgtgcaacatcaagcacaattttggctgaacattgctgacgaataagcggtatcaattgctctgcaggctgtctaatccctgttacatttgacaccaaattaaacgcaacgattttagtgcgttctgataaggctgtttgtagcgtttcaggggcaatttggtagtcgctattaagcggtagcacaatcaacctcgcttgtttacgctcagcaagttgttgccacggaataaaattagcgtgatgttctgccacagaaatcacaatttcatcaccagcttcaatactgtcagctaaaccatttgcgactaaattaagtgaatgggttgtgccacttgtccagataaccgcatctcgtgttgcaacattgaaacgttttgccactaaatcccttgctaattcataacgttgcgtttgaggaaaatcatattgactacggtgaaccgaaccagatgaacgataaaaattgagcgttgcgtctatcaacactttcggtttgagtgtcgttgcggcagtgtctaaatataccgcatcgggattatcttgaaaaaaagggaaataggaacgaaaagtgtgattaatcattgtcgctgagcctttctataaagtttattacaagggataccatcattattgccgtctagctctcgccaacggcattgtttaaagtagcgtttcgccgtgtcataatcgggaagatcgttacaacttttcctcacattacaatctatagtggcaagcggtgccttaggcgaaaaaccttgccaaaatgaatgttcatctgaccgcttacttgcacgccagtccgcaggattgatcggatttttatcttgccataaacctattctttgctgttgagcaagttgttgagcttgcagatacacaggttgtgtttggcgatacgcccacgccattcctcgttgcacctgaattaagttaagattttcacccgtctgatcataaaccactgccaacagccgttgatatttatcataccccgtaatctcaagttcaacctcttttttaaatgccagttgagctaacgattgcttcgccttattaccaaaaggctgggcaaattctggggcatcaatatattgcaggcgtactttaagttgtgtccgattgtgcaagcaggttaaagtatcgccatcataaatacctacaactatacatattttctgtgctatatgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggttcatttgaaaaaaatagagaaagtaatattgctaatttatggtagtaaatagtttttttcatattttaagtaatatttaaatagaaggctatttgccatttataaaatgatatagataatagaaactatgtatttaacccagcatgctaataaaaaataaagtaatgctgattaggaaaacgattttctaatatagtaaatacatgctattctaggtcaattgtagttgttacattcaaaattcagactaatgaaaccaattttcttagagcttcgtcatttacgaactattattgctttaaaaacagcattatctcatcaaattaaattgttagaagatcaatatgatctaactctatttgaacgtaaaactcagccaatccattttactccagctggagaacgtttagtacagctcgcttatgaaattttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaaaataatagaagctgaatcagatataacccgaattaaacaaggagaagttggagaattacggattgctgttgaatgccacacttgttttgattggttaatgccagcaatggatatttttagacaaaattgggggggaatagaattagatattgtgtctggttttcatactgatactgttggtctattgcttgctcaccgagcagactgggctgttgtatcagaaatagaagagtccattggtattatttataaacctttattttcttatgaaatggttgctatttgtgccaaagatcaccctttggctcaaaaagaaatttgggaagctgaagattttcgtcacgaaacactaattcattatcctgttcccgacaatatgttagatttattgaaaaaaatcttacaaccagtaggaataaacccaacaagacgcactagtgaattaactatcgcaatcattcagcttgttgccagtaaaagaggtattgcagccttaccttattgggctgtaaaaccatatttagaaaaaggctatgttgttgcaagaaaaatcacttctaatggcttatatagcaatttatacgcagcaatcagggaaacagatctagataaagtttacattgaagagtttcacaatatagtgaaatcgcaaagctttgccacattattagatctattttctttagattagaaatattatttatgagtacaccaacttcccatttagatattttaagctaaatgggatctgtaataattacttatctgctactgatactttcagcttttgccgttaagttttctgcacccgtcgctctcatcacaatgttatcttctgtccgaatgccaccgtagcctttaaattcgtcgattttctgccagttaaagaaaggtgcaagcgggtggtttttccattgatttagcaacatctcaataaaatagaacccaggctcaatggtgagaaccataccttcggctaaatcacgagtgcaacgcaaacttgggtaaatctcaggcggagctttgcgagtgccacgatggttttgttggaaacctgcaacatcgtggacttgcaaaccaagctgatgccctaaaccgtgtgggaagaaagtacggctaataccctcttcaaaaatttgatcagcaggtaatttcacaaactcaaactggtgaagcatttgcgagatccaacggtgcatttgggtatggtaacttagataattaatccccacttgcatatcagcaatagtatccagtttaaactgttccatttgagcaaccattgtggcaaattcactttgtggctcaaaagcataagttcgagtaagatcggaggcataaccaagatagcttgtgccagcgtcaagtaaaaaactgtggcgttcgcaaggtggtgtgaaatccaattttgtgtaatgtaaaatcgcactatgctgattgacggcaacaatatttccataaggcacattgttatccgattgcttggtcgcttgaagataggctagattaatttcaaactcacttttaccggcaaagaaagcctcttttgccgcgtgatgtcctgttaaagcggtgagttgagcttgatatatgcactcaatttcaaattcgcttttgatcgaacgctcaaaatgcagtacatttagcattttctgtggattgatatgctcaaaacctagcgatttggcaagctccgtttgttcaccaataaaggcacaatgggtcggattaaggatatattgttgaatttgttggctatccgtgagcatttgccattcaaactcatcagcaaaaaatgccgatgtcggtggatttggcgtacaatgccaataatcttgaggtgcataaaaatagagtttcggtttatttttaccgtctaaaaaaagccaactttgttctgcggtgggatcagggaaaatataattaaaatgcggattgattttaaatggcgatgtttggtcgtctaaaaaatgatattttgcctgccctgcataaatccaaagcccgtcaagacgagccagctctaaggcgtgctgtacgatttgttgaatacgtgcgatgtgttgagagaaaagctgttgcatatatatcctgtaatttttaattttgaataataacgatgaccgaactaaccattaaccacactttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngataccctagggctacgttgtcctgaacctgtaatgcttactcgcaaaaccattcgcaatatggcagatggtgaagtgttgctaattattgctgacgatcctgcaactactcgtgatattccgagtttttgtcaatttatggatcatcagctattaaaaagtcaaacagatactaagccgtatcaatattgggtgaaaaaggggctagaccacctttaaactttttgtaatttcaaatctatcatctaaaaattctttcttcagacgagatatttctccaagtatctcttcttcagaagatagaatattatcatctttacgtaatagttgattatgtgctgttaaaatagtacgtacatatttttcccactgtttctctggaattttctgtacatatgcagataaaaagagtaattcaatattagaataataaatcccaccacctgacacaggacttgccagatagttaacgttattaaaagcaaaaggattatccaatatagctcggttaaatttctggcaggaatttgtagctgcttctattgtttcagccgattgagtaatgacaacttcttttcgagctactaatagggcaattattctaaataatgcatttggaggcatatccccttttaaggcttcacacaaagattctaacgagtgaatcttataatcagataatttttcaataataggttttaataattcttctttaaattccgtttgtcggtagtttttaatcgtggtcgaaatttttgttgtagatgaaacaagtaatatatttaatttcttccattctttctctccttgttgattagtaagttgagattttcctttaacccaataatcacggcggaattgtttatttaaaataaagtcttttgctgtttgaaataaagaaggatcttgaatgctagataataatttttgttgctcttcatcaaataaaacctcatcaaaatcatctaaataagaaacggagcatgcgtaacttaatttagcttgtttcaagcaggattcaatttctgaaaaatacattggataccaattctgattagtaaattcatgaatgacgtaattagaattttgttctttgatctgttcaacttgttccaacaaataaggtgagagagaaaggagactattactcactgaaagcatattctttgtatgttctaatgctgatttaatcgcttgatcttttgattctagagtagcagataatttactatagtattgatttaataaatatctaattggtgattttcctgcccatcctggtaatgtgttatagctaatatagactacaccacctacttttaatttacgttgaataaaatcaacgatagtttctctattttgtggtgaaatccaagaccaaataccatgtagagcaataaaatcaaaatcaggtaagtcatctcgatgacaaaattcggcaaaagattgatctgcaataacgactttatctggattgccttggtttgctaattgttgagcaaagaacgcatgagaaggattaaaatcagtcccgtaccattttactgttcctgctactgcatgaatattaagcgatacaccaaacccaaaacctaactcacacgcattaatgacttttggcggctgtaaatttgctattaagaatggacaaattaattggtggctatttaatccatcgtaataacctgtcgtataattaatatcattaacataaccttctgaccaatttgttagcattgctcctccttattacttgattcttacatggtaaatattctacatagggttatcatttattttcataattctgctaatggttaacgtctttcatcatcaaaatcatcatcttcgtcatcgaaaaattcgccgtcatcaccatattcatcttcatcactgttcggatcttcaaaataagttccccagccttcgtagaccgcacccgatttttcgattaacggcagtagctctttttgttgagcggtaataagttccgcatctagtttaatttcgctgacaatatcgcacacaaacacaagatcgccattctcttcttccacttcttccgcttcagaaatctcatagcccaacttataagcatctaccactaatttttcgagtttatcgaaatcgtggtgagcaacgtggtgttcgataatataaagggcttcaggatcgctgccatcgtctaataaagagttgatgatttcatcggtttcttggcgtaattcggttaagttgtacataagattagccctcttgggtttgtgtaaaaatttcggcgaaccaactatctaatttagtcgcaagtttatcaataccaatacgatttaatgcagaataggcttcgacttgcacatcgccttgaaacggtaaaatcgcttcccgcaccattttgacggttttgcttctcgcactttggctaagtttatccgctttggtaagtagcaataatacaggcaactccgcagataccgcccactcgatcatctgctgatcgagatctttcaacgggtggcgaatatccattaaaatcactacgccccgtaaacattcacgtttctgcaagtattcacctaaagaacgttgccactgaagtttcatctgctcaggcaccgccgcataaccatagcctggtaaatcgactaatttacaatttggttctacttcaaataagttaattaactgcgtacgccctggggttttagaggtacgagccaagtttttttgattagttaaggcatttaatgccgtcgacttccctgcatttgaacgccctgcaaaggcaatttccacgccactgtcttctggtaaatggtgaatatcaggtgcagaggttaaaaaatgggttttgtggtagttaagttttatttcggtcattttgtatttgtttgttattaaaatttgtaactagctcccctctttgaaaaagaggggctgggggagatttaaaaaacagttttgtagggtgggttttaacccaccaataaattcaagagattacaacggaatggtgggtcaagacccaccctacaattatttaaatctcacactcaatcctttctcaccatattgattagcttcaggatttcctgcaaaaacaccccattccatcactaaaatcgttccgataaacatcggcatcataatgcctagcacaaatgccattgttccttgagctcccaatgaactgagataacacaatatcggcaccgcaaccataaacaaggctttcgccgaacgattacggtcgtgtaggcgtttaacgatcactgcagataaactgtaaagtgaaagggtcaagggtagaacgctaatccagctgaaagcggtcggatttaagataaaatttgcaaaaataaacaaaaatgcaaaattaatcccaaagccgatccaaaagcctttacggtttaaccttccgtgaaaagaaaataatgctttatgccagatcattactgcaatgccttttcaattttttcaaacaaatcacgcgcaagattatctaaacctttcaaacgctctaagccgcgacgcatcagggtttgacgttgagtgtcatagcgagaaagtttaattaacggctcaattaagcgtgccgccacttgcggattgctttcattcatcttaatcaacatatcgactaagaaacggtagccagagccgtcaatagcgtggaatgcacttgggttttggcttgcaaatgccccaactaatgaacgtacacggtttggatttttgaagttaaaacttgggtgcgttaataaattttgcacaatttcaagcacattttcatcaggacgtgtcgcctgtaaagcaaaccatttatccatcactaagccatcgtgttgccatttttgttcaaaatcggcaagaagctgatctctgcaagcaagttgtgctttggtcgaagctgagagtgccgccaaagtgtccgtcatattatttgcttgatgataatgtttgtgcaccaaggtattccctacttcagtaaaggcaaggtaagacaagcagacattgcgtaatgcccgttttgccaaatcctcggcaaccacacggtattccgttaatttattttggttgtaaacgactaagaagtgatcttttaattcatcagcaatcgcttgttgcataaattgacgaacagccgcaatacctgcaggatcgatcactttaaataactctgcaaattccgtttcttttggcaaggttaaggttaaagcggcgagttctgggtctttatttgcattgtcgataacaaaggtgagcgcttctaacaaaccttgtgagaatgccattgcttcgccctgttggtagcgacttagattttcacgcagctcattgttaaacaacatttgtgccacgtcccaacgcacaaaatcattctcagcaaatttcaagagcgtcaaaagctgttctgtcgaataatcataatctaaacgcacaggggctgagaaatcacataacaaggcaggcactggacgttgttgcacattgtggaactcaaaggtttgatgttcgtggaccacatctaacacatcactgacagttaataattcgtgttgtaacttgattttcttaccatcttgaccatataacgctactttcaacggaatgtgtaaattcactttctcaagctgatcggcggttggtggtgtgttttgagaaacgtgcaaacggtaagtatgacgtttttcatcatattcatctgaaatcgttaattcaggcgtacccgattggctataccaacggcggaacagatctaaatcaactcccgaagcacgttccattgcagacacaaaatcttcacaggttgccgctgtgccatcattttctgccacatagagtttcattcctttttggaaacgctcttcgccgagtaaggtgtggatcatacgaataacttcagcccctttttcatagacggtaaccgtatagaaattattcatttcaatcactttttcagggcgaatagggtgagccatcgggcttgcatcttcggcaaattgcaccgcacgcaacaatcgcacatcttcaatccgttttgccgatcttgaccataaatctgaagtaaattcttgatcacggaaaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcgtccgttgcagtttgcggattagccagcacaaatttcgagttaaaaatgtttaaccccttattttccattgcccccatattaaagaaatcgaccgccacgatcatataaatgtctaaatcgtactccagcccaaaacgctcttcgtcccatttcatcgaacgttttaaactctccattgcccaagtggcacggtcaagatttcctttatccacatagatttcaagggcaacttcacgtccgctcatcgtgataaacttatcttgtaacaggtcaaaatcccctgcgactaaggcaaataaatagcttggtttaaagaacggatcttcccactccacccagtgacgaccatcgtccagctccccttgagcaatacggttgccgttagaaagcaggtatggatatttacttttacaagcggtgattttggtgcgatattttgcaagcacatcagggcgatcaagcatataagtaatctgacggaaaccttccgcttcacattgcgtgcagatcccttcgcctgattgatataacccttgtagtgacgtatttgttgatggattgagttttgtctgaatttccagctcgaattgatccgcagggaaatcggctaaatttaaagtcaaagcctcatcatctttttgatattctttaaacggctcgccattaaatttaatcgataaaaattcaaagctatgcccatctaaacgtaacgtagtcgcttctgcatttttacgcatgaccgacaacgtcgatgtgacaatcgtctgctcaggatcaagctgaacatcaagataaatttgatgaatcgtaaaatcaggctgacggtaatcttttctaaattttgctttaggttgcatagcttttcccttagnnnnnnnnaatatggaaaggataagagtatttgtctttaagtgcaatcaaatttaagatcttgccccaaaaatcgccgtaccaatacgcaccattgtcgaaccgcattcaattgcacttggcatatcatcagacattcccattgatagcgtatcaatcccttcaaattgagattgtaattgaagaaacagttcattcatttgagctaaggcgattttctgttgctcaggctcactttcaggcttcggaattgccattaaaccacgcaatttcaaacgtggcagttggctaatttgagtggctaattctagcatttctttcgcagaaatacccgatttagatgcttcatcactgatattaatttgaattaaaacattcagtacaggcaggtgttcaggacgttgctcgcttaaacgttgtgcaattttgagcctatctatcgtttgtacccagtcaaaatgctccgccactacacgcgttttattcgattgtaataaaccgataaagtgccattctaatgtgtcgttctccgcaaaatgctgaattttttcaataccttcttgcacataattttcgccaaaggcacgttgccctgcttcaatggcttcggcaatggctgaaatgggtttagttttgctcaccgcaagcagtttaacactctgttcagggcgattagcttgctgacaatattgttgaatttgttgagaaattgtcgctaaattttgagaaatcgacattggctactccaaaaggctataatgggcaagatcataaaactccacttaactgaaatcaaggatacttatgcaaagactaacaaaaattaaacttgtgattaccgatgtggacggtgtactcactgatggtagcctttattacaccgaaaatggcgaagcattaaaatacttcaatgtgaaagacggtttagggatcaaaatgcttcttgcttgcggcattcaagttgcagtgctatcgggcggtgacaccccgattttacgccgtcgcatcaaagatttaggcattccccttttccaacttggcaaaatgtctaagcgtgatgcctgttttgagttaatgcaacaagcgggggtttcagccgaagaaactgcatttttaggcgacgatacactggacttacccgcatttgaagtctgtggattagcagttgccgtgggcgatgcttttgattatgttaaaaatcaggcagatttagtcttaacgcgtaaaggcggacattccgcattccgtgagctttccgatatgattttaaaagctcaaggcaaagaagaagtttatgctactgctgatgggtttatgaaagtggtgcatgaaatgctacaataaataatatcctgtggaattttagataattaattgaaaaagatgagccaacaagacaaacaaaatttaatttggatcgatctcgaaatgacagggcttgatcctgaaaaagagcgaattatagagattgctaccattatcaccgataaagatctgaatattttggctgaaggccctgtgcttgccgtatatcaacccgatgaattattaaataaaatgagcgaatggtgtgtgaaaacccatactgcaaatgggttggttgagcgtgtgaagcagagtaaattaaccgaacgtgctgccgaattacagacattagatttcctgaagaaatgggtgccgaagggggcttcgccgatttgtggtaatagcattgcacaagataagcgtttcctttataaatatatgccagatttggcggactacttccactatcgccatttagatgtgagtacattaaaagagcttgcgagccgttggaagcctgaaatgcttaaacaatttagtaagaaaaacagccacttagctttagatgatattaaagagtctatcgaagagctgaagttttatcgtcaccattttattaatttagattaacaataatgcaatcattttattttgcaactgaagaagaaatgctcaattttggtcagcgttttgcccaacaacttcaacgctatttagaaaatcatagtgaaaaagcgattgtgatttatctgaatggagaattaggggctggaaaaacgacgctcactcggagcattgttcgtgcttttgggcataatgggaatgtaaaaagtccaacttatactttagttgaagagtatcagcttcccccttatgctttatatcattttgatttatatcgtttgagtgatcctgaagagttagaatttatgggaattagggactacttccgtccacaaacggtttgcttactagaatgggcaagtcgaggggaaggaatgatcccatctgcggactttattattcaaattgactatgcagaaacagggcgaaatctagctcttatgcctcaaaacaactcagcaaaacagattgtagattatttagaacatcagaccgcttagggtaatactatgcagaaattacgacattatgtttgttttacggtaatgagtttatttcttgctctttccgcacaagcaaaattaaccattgccattgatgctggacacgggggcaaagatccaggggctatcggtaaaaatttaggggttaaagaaaaagaagtgactttagcgattgccagagaactaaaggcgttgttagatgcagatccaaatttcaaggcagtaatgacacgcaatggcgactattttatccagttacctaatcgaactgaaattgctcgtaaaaataaggcacattatctagtgtcaattcacgctgattcttcaccaagttcagataatctaaaaggggcttcggtttgggttttatctaatcgccgtgcaaatgatgaattaggaaaatggttggaagatcacgaaaagcaatcggaattattaggtggggcaggttcggttttagcaaataataatgaacgttacttgaaccagacagtgcttgatctgcagttttctcacgcacaacgttcaggctatgagttaggtaaaacagtcttagacaaactgagaaatgttacgcaattagcaaaaagttcgccacaacacgccagccttagcgtattgcgttcccctgatattccttcaattctagtggaaacaggctttttatctaatgcaacggaagaacaacgtttagctacaaaggcttatcgccgtcagattgcaaaggcgatttatcaaggattaattgcatataaaaatagattaccaaaacagccaaatcaaatagcagttaatgatgaaaaatcaaccaagaaatcgaaagctgaaaaaaaggtagaaaatcgctctaaggaagataaaaaagctaaagtagcggtgacttcgcctaaggaaaaaactaaagagaaaacaaaaataacgacgaaaactaagcaagaacaatcgtctaaagcgtcagaaaaaacggttaatctcaatgcgaaatatcatgttgtccagaaagatgaaacactttattccattgctcgcatgtataaaacaacacctgaaaaattgagccagctaaatggtttaaaacaaaataaaatctttgtagggaataagctgcaagtaaagtaaatcaatatagtagagtatcaaatttaaaactggatatgggaaccaagacaaaatagtagagaaataagcatgatatttaaagaaaagccgattatttctaatcagcacggagcattagtgatggcatttgtaccatttatttatggtatttctgctagccattttgtaatgaatcatttttggcttgggcttagctggttttttacttatctcttttcctatccttttttctccgtcgttagcaaaaaacaaaatgaaaaatataaacgctggatgattatttatgccgtatttagcggcatatttatatttcccgtactcttaagtcatttttctattttgcaatttataatcccaatcctgccgcttgcagggttccaaatttactatgcaaaacaaaaagatgaacgaaacttaatcaatgatattgcaggtattttaaccttcggcataattggaatggcaagtttctatttagcaacaaaccaatataattttgagattttactccaccctacgttattttttattgggacaacaatttatgtaaaaagcgttgctcgagagcggaaaaatcctctttactgtaagttcagtataggacttcattgtatatttatctttgtttatctcgccttaggcgattatggcattagctttgcctatttcattgggttaattagagcggttattgtgccaaaaagaaactggaaaattaaacaagtcggtctatttgaatttttagtgatatttgtttttacactagggctgatctactaaatgtattaacctaataatgtccgttatttctctttccaatatccaatccattctttcagggcgtgcatattgctatgtaatgcccctgattgtgggataaagtaaaatacatttaatccataggtttcaggcattttccccgcgccaacacttgcaggtaatatctcaaaaccttctcgttcaaataacattcttgctcgttgcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccactggtttgtcactagcacaatcttattaataccttctttttctaaaataggtttagaaaacttcgcattttcagccgtcgttttggctttttcttccaaccattgtgttggaatatggaaaaattgtgctagctcttttttcattacgccagcttctgaagtcccttttgggctacttcccgtaatcaataaaggtaagcccgtttctttttgtaaaaaagcagcataacgtacccgctctaatgctatttcgctgatcgctaatttgccaaataactctttactatcacgcaagccaccactaagtaaaacgatagcttgagccgatttataatcttcaatactaaggttatcttccgttaccagagaatcatgcaatttttgcgaagtatagggaatactgaaaatatagagcattgctacacctaaaaaagttgagagataacctaattttttccattttaagcggaaacaaattaaagaaaacaaccataaaatcagaatgttaaatggtggaagaatgaccgcagtaataaattttgtgatagcaaacataatgagtaggcaattttgtcaagtaagtaaaagagatttattattcctcattccttttccgttgtctattgtttaactcgctctttaagattaaaatggcaagtcttattaaccatattactagcggttagatttatgaaaaaaattgcaattattccagccagagcaggctcgaaagggattaaagataaaaacttacaattagttggcggaatttcgctcgtaggccgtgcagttctagcagcaaaagagtctggaatgtttgacttaatcgttgtcacttcagacggcgaacgtattttacaggaaggtgaaaaatatggtgcaacaccactacttcgccctgctgaattggctcaaagtgatactcgcactattgatgttattttgcactgtttagaaaccttaaacattcgtgaaggcgttgtcgctcatttccaaccaactagcccacttcgcaatgcgttagatattcgcaatgcgatggaaatctttttaggtggaaaaagtaagtctgtggtatccgcttgtgaatgtgaacaccacccgtataaatcatttgttttaaatggagatgatattctcccgatgaatgaaatcaaagattttgaagcaccacgtcagcaattaccaaaagcataccgtgcgaatggggcgatttatatcaacgatatcgccagcctacttcaagaaaaatacttttttattccacctgtgcgtttctatttaatgccaacctatcgctcagtcgatattgataccacattagatttgcaactggcggatagcttgattgagaaagagatgcaatgagagccatcaaaaacagtgcagtttatttaatcggtgaactgacttcacgggcaatgccattttccaagccttattaggtgttcagctgagcattcgacagtgtcaaaaacaggcgatttcctatgccattttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattatgttagtgttattaatgtttttatctttatttggcaatgaaggtaaaaataaaattctatttttaaataacaagacagaaaatgtttagtattattattccttcttataatcgaaaaaatgaaattcctgcattattaacaagtttggaatatcaaacggaatataattttgaagtgattattgtcgatgatcactctgttgagccagtagaaattaaacatctctacccatttcctgtcaatgtgattaggaatgaacagaatttaggagcagcagaaagtcgtaatgtaggagcaagatttgctgaaaacgagtggctactctttttagatgatgatgatcgttttgctcatccaaaatgtgaaatactggcaaaaacaattaatgaaaacccgacgattaattttatttatcaccctgctgaatgtgtgatggtaaatgaagggtttagttatatcactcgcccctatgaaaatgaacaagcggtcactttagagaatattttactggcaaataaagtaggtggaatgccgatgattgcgattaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaaatcatttttctttgcagtcaatggattatcaacggatttaaaatctttagaagactatgattttattttgaaagtgatttctcataaccagtttaaaccaaaatatgtttctgaagccctaacaacctgtactttccatactaaacgagcaagtgtatcgacaaatacacaaaatactgaattagcgattgaaactattaaacaaaaatatgtaaaaacagatattcaacaaaaaaactttgcttttaatgcattatatatgctttcttacccacatataatgaatttatctcgtaaagcggcttgttattattggcagatgttcttacaaagtaaaaatattaaacatttggtgattgctactctcatatttatttcaccaaaacttgcaatcaatatgaaaaggtttatttaatgaaattttccgtattaatgtccttatattttaaggaaaaaccagaatatttaaccgaatgctttgaaagtttaaaaaatcaaacggttcaagcggacgaaattgttgttgtatttgacggagctattacccccgaattagaacaagttatgcaaaattttgcggagatcttaccgcttaatatcgttagacttgagcaaaatcaagggttaggaaaagcactcaatcatggcttaatccactgcataaatgaatgggtattccgtatggatacggacgatatttgtattccagaacgttttgaaaaacagattgcgtttattgaacaaaatcccgataccattatttttggcggacaaattgctgaatttggctcagatattaatgatattgtcagctaccgccgtgtaccaacggaaaccaaagccattgtggaatttacgcagaaacgttgcccatttaatcatatgacggtcgcctaccaaaaaagtgccgtgcttgaatgtggtggctatcaagacctacaagaagattactatctctggattaaattggttgcattaggcaaaaaagtggcgaatttacccgaaattttggtttatgcccgtgttggaaatggtatggtcggtcgccgttgtggtatcgctcaggctaaggcagaatggcgtttatttaaattaaaacaccaagtgggtatgcaaaatgttgtttcaggttttatcacttttactatgcgagtgataccgagattgttgccaacagtcttacttactcagttttataaattacttcgtaaataaaaggtgtaatatgttgtctatacaagatttttcaaataaaaatagttgctaatatttagagaaaataaatattagcaactattttgtctaccatgccgattattccttatgaagagcgataaacatagttaattattctgttttaagcgataacgtctatccatcatacaaagtatgccacctatcgccataaacaatccaccgaaccaaatccaacggataaacggtttgtagtataaacgtacgccccaagagccatcttctaaacgttcacctaaggctgcatagagatctcgactaaatccccagtcaatcgcagcttcagtcatacccattttactgacattgtaaaagcgtttttctgcgtgtagtgtggcttcatatttaccatttcgatgaatttcaatatccgctgtgccaccaatatagtttgccccatttgagtcacgaatacccttgaaggtaaagttgtaatctaaaatttcaactttgtcgcctacattcattcgtacatctttttcgatactgtaattttggctaaaggcaataccaaacacagtcattgcaacccctaaatgagccaacaccattccccaatgggaacgagaaagtttcaaaatgccttgcaagaaactatgacgatgcgttgctcgttgatgtagttcatataaactcaatgccacgataatgacggacatcattgtccctaataccacgctgacagtaattttgctggcaaaaagataaggtaatccaaagccaagcaatatcattacggctaatgaaatgagaactggcttacggatagcagaaacctgatctcgacgccattttacaagcggtccaatccccaataaaaatgcaaaaggcaccattaagatcataaacatttgatcgaagaaaggcgccccgatagaaattgtccctaaaccaatttgtttatgaattaacggtaaaatcgtgcctaaaaagaccaccgataagaacgccattaatagcacattattgagtaataacattgactctcgtgagtaacgttcggaattgtctaagctcttgattttactgccttgataagcgtaaagcagtagcgaaccgccaataaccaccacgagataagccaaaatatataagcctcgagttggatcagaagcaaaagcgtgaaccgataccaaaatccctgaacgcactaagaatgtgccgagtaagcagagtgaaaaagcaagaatagctagcaagaccgtccacgctttgaaagtactacgtttttccgtaaccgctaaagagtgaattaatgcagtacctgcaatccacggcattaacgaggcattttccacaggatcccagaaccaccaaccgccccagccaagctcgtaatatgcccaccaagagccaagtacgatacctaatgtcaaaaatacccacgctgccatagtccaaggacgtgaccatctcgcccaagcagtatcaagacgacctgtcatcaacgacgcaatagcaaaagcaaaggcaacagaaaagcccacatagcccatatacagtaacggagggtggaagattaagccaacatcttgcaacatcggattaagctctcgaccatcaacaggaaaatcagggaaagttcggttaaacgggttagaagtaaacagaataaagactaaaaagccaatgctaaccaagcccattacccccaatacacgagcgatggcttcttcaggcatttgtcggctgaatgtcgcaacggcaacgctccaaagggaaagtagccaaatccaaagcaacaaagatccttcgtgagaaccccaaacagcggaaaggcgatactctaacggtaacgtactgtttgagttattcaccacatactgcacagtgaaatcattgaccgcaaacagataaaaaagcgagccaaacgagattgataatgctaaaaaaaccgcccacgtcatcggacgagccaatgccatcagactagcattttgtttataagcaccaacaagcggtaagatcgccaataaaattgccaatgcgagagcaagagcaagggtatagttacctaattcagcaatcatttattttctccaaacggctgagagatctgcgttgcatcacgttctgattttcctttgagatctgcttctgaaatccccatcggctgatgttgctttttcatctgatcgcctaattcaggtggcatatagttttcatcgtgtttagctaacacttcggttgctttcagttttgtcggctcaactaaagtaccttgtgccacaatcccttgcccttcacggaataagtcaggcaaaatcccttcatattccacctgaattgcaggcccaatatcattgagatcaaaggtcactttaagggtcttatcatcacgttttaccgacccatcaaccaccataccccctacacgaatacgttgcccaacttcaggcttggtttctggatcattatttttaccatagataatctctgatggcgtatagaataagtcaatgttttggcttaacgcatataaggttaaaccaacagcaacggcaagcccacttaacactgccatcaccactttcagtctagatttgcgtcttgggttcataaaaacctcgttgtaatcactcaaaaaacaaatagaaaaattaaagtgctatcctaacaaaaaatctgataagaatcgttaaatattcgattattttattctttagtatataaaaatcatgtctaccctaagacaggaaatggtcgaacattctctaattgagaatgtatttgattaggtacggttgatcctaaagtccaagaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccaagaaattatactgcctctttcgatgttacttgtgtactttaggggatgccaaacatagagagaagcaagaattgcttgtttttgaacataaatataggtagaaataaccgcaccttattgttataagttgcggttattttttgctacttataaggctttcaaaatatcgtccacacgttcttttgcatcaccaaataacatttgggtgttttctttgaagaacagtgggttttgtacgcctgcatagcccactgccattgagcgtttgaacacgataacgttttgggctttccaaacttcaagtactggcatacctgcaatcgggctatttggatcgtccattgccgctgggtttactgtgtcgtttgcaccgataaccaagactacgtcagtatctgcaaaatcgtcgttgatttcgtccatttctaatactacatcgtaaggcactttcgcttcagcaagtaatacgttcatatgtcctggtaaacgtcctgcaactgggtggataccaaagcgaacattgatgccacggtcgcgtaatttttgggtgatttctgccacaggatattgtgcttgtgccactgccataccgtatcctggcgtgatgatcacagagcttgcatttttaagtaattctgccacttcttctgcggtagtttcacggtgttcaccttgttcttcatctgagctgacttgaacatcgttaccaaagccacctgcgataacgctgatgaacgagcggttcattgctttacacataatgtaagaaaggatcgcacctgaagaaccgaccaatgcaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgataagcaagtcgttactcaacataaagcctgccgctgccgccgcccaacctgaataagagttaagcatagacacaaccactggcatatccgcaccaccgatagaagccaccaagtgccaaccgaaggctagagcaattgcagtcatcactaacacagggaaaatattttctgggttatttaagaaagcaaccattaataatgcagaaactacaagtgccgcaaggtttaatttgtggcggtgtggcaacattaatgcttttgaattgataatgccgcgtaatttaccgaaagcaaccactgaacctgtgaaagtgaccgcaccgatgaagataccaaggaatacctcaacattgtggatattttgtagcactggatctgtttcgtgtgcaagaccgtagctgttaaagccgactaataccgccgctaaacctacgaagctgtgaagaattgccacaagctcaggcatttcggtcatttcaacttttaatgcttgacgaataccgatagcaccaccgattgccattgcgattaaaatccaaatggtaccttgtgattgtggtccaaaaatggttgcgataagggcaatgaccatccccacaataccgtaccaacaacctgcttttgccgtttcgtgtttagaaagccctgcaaggctcataataaagagaacggctgcgacaatatatgccgcttgtactaaacctaaagacatactctttctccttaaccttttctaaacattgctagcattctttgggtaactttgaagccaccgaagatgttgatgcttgccactaaaatcgcaataaaggcaagtacgctgataaagaagctgccttgagagatttgtagtaacgcaccgacaatgataatacctgaaatcgcattggttactgccattaatggcgtatgtaatgcgtggctgacgttccaaactacatagtaacccactacgcaagagagaacgaagacggtgaagtgagataagaatgctgcaggtgcaacagaagctaaccacaagaatgcgatcaccgctaaggctaacaagccatatttaatgcgtggatctgccggtttttcttcttttttctccgcaggttttgctgccgctttttgttgtggctgtgcagatacttgaattggtggtgctggccaagtgacttcgccatcacggattacggtaacgccacgcaatactacatcttcaaagtcgatattgatgttgccatctttctctttgcagagtaatttcaagagattgactaagttggtgccgtaaagttgagatgattgagttggtaaacgacctggtaaatcagtataaccgataatttttacttgtttttctgtggtaaccactttacctgcttgggttaattcgcagttaccgcccgttgcagccgctaaatccacaatcaccgaacctggtttcattgtggcaaccatctctttggtaattaagcgtggggctggtttgcctgggataagtgcggtggtaataataatatccacttcttttgcttgttcagcatagagtgctaatgcacggcggttaaattcttccgacatcacttttgcatagccatcaccgctgccaccttcctctttaaaatcaatttcaaggaaacttgcacccattgattgtacttgttcttttacttcaggacgagagtcgaacgcacgcacgatggcaccaaggctgtttgctgcaccaattgcggctaaacctgcaacgcctgcaccgatcacaagtactttcgcaggtggcactttacctgcggcggtaatttgacctgtaaagaagctaccaaattcgtgagcggcttcaacaacggcacgataaccagcaatgttcgccatagaacttaaagcatctagggcttgcgcacgagaaatacgcggcactgcgtccatcgctaacacattgattttctttgcagaaagtttttgcattaattcaggattttgagcaggccaaataaagctcacaagcgttgccccttccttgattaatgcaatttcagcatcggttggtgcattgactttaaaaataatgtctgcattccaaacggcttgtgcgttgccgatagtcgcacctgcttgagcgaaagcatcgtcttcaaaacttgctttaaagccagcattttcttcaatgatgacttcaaaaccaagtttcttaatctgttctacggtttttggcgttgctgccacacgagtttcaccgtctaacagctctcttggtacaccaataagcataaagactcctgtaggttggttaaaataataatgaattaaaacgttgcaaatgtaccatttatttaactttttgggggatttttttcacgtttattttgaagaaatcttaaaatcatttaaccgattttttacaagcggaggatttcgtaataaaacttgcaaaagataaattattcgttggagttattaggacttttttgctatatttatgcccaattttttgccctaagtctatgggcttatttcgcttttaactaaatttaatggatcccttttatgtttaagaaatttctaggattattttcaaacgacctttcaattgaccttggtactgcaaacacgttaatttatgtaaaagggcagggtatcgtgcttgatgagccgtcagtagttgcggtacgtcaagatcgtgctggttcatcaaaaagtattgcagcagtaggtagtaatgcaaaatcaatgctaggtcgtacaccaaaaagcattttagctattcgtccgatgaaagatggggtgattgctgatttctatgtgacagaaaaaatgttacagcattttatcaaacaagtgcatagcaataactttatgcgtccaagtcctcgagtgttagtgtgtgtaccagcaggggcaactcaagtagagcgtaaggcaattaaagagtcggcgattggtgctggtgctcgtgaagtttatttaattgaagagcctatggctgcggcgattggtgcaggcttacctgtagcagaagctgctggttcaatggtaattgatattggcggtggtacaacagaagttgcggtactttcattaaacggtatcgttcattctgcttcggtgcgtattggtggtgataaattagatgaagcaatcatcgcttacgttcgccgtcactatggttctgcgattggtgaaacaactgcagagcgtatcaaaaaagagatagcaacagcttatattcaaaatcaagatgaaattcgcacaatggaagttcacggtcacaatcttgcagaaggtgcgcctcgtacattcgtgttaagctcaaaagaagtgttagaagcgattgaacaacctttaacaggcattgttgatgcagtaaaaggggttctagagcaatgtccaccagagttggctgccgatatttttgaacgtggaatggtattaacaggtggcggtgctttattacaaaatcttgatgtattactttcagaagcaacgggcgtgcctgttatcgttgccgaagatccattaacttgtgtagctcgtggtggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaagcacttgagatgatcgatatgcacggtggcgatctctttagtgacgacaactaattcaaccttgagttattagcataaaaatggacaatatcaacggctattgtccattttgcatttaacaagatccattaaatataactgaaatatgaaaccaatttttgcgaaagcaccacctatcggcgtaagactattctttgcaattgcgatctctatcagcctgattttacttgatggtagaagcagtgcaatgatccaaatgcgtaatgtcctcgaaacagcggtcagtggcttgtattattttgcaaatacccctcgcaccgtattagacggtgtaagtaacaactttatcgacagtcaaaaactgcaagttgaaaaccgagtattaaaagaacaactgcgtgaaaagaacgcagacttattgctactcgatcaactcaaagtggaaaaccaacgtttacgtttactactcagttcccctttacgccaagatgaatataaaaaagtagctgaagtgctgaccgcagaaatggacgcttaccgccaacaagtagtaataaatcagggacaaagtgacggtgcttttgttggtcagcccgtaattgatgaacgaggcgttgtggggcaagtgatttctgtcgggaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtagtcgagtattacttttaaccgatgtcactcacgccattcccgtacaaattttgcgtaacgatgttcgagcaatagccaatggcaacggacacagcaatgaattgattttggataacttaccaagaaccgtggatattggcaaaggtgatgtacttgtcacctctggcttaggcggacgtttccctgaaggctatcccgttgccgtaattgaaaccgtacaaaatgatggttcaaaccattttgccagagcaacggctagaccgctcgcctcacttgatcgcctgcgttatttattactgttatggccaacaagcgaagaaatccgcaatgcattaagcctttcaccgcaagatgtgcgtgatgctgtggaagaaagacgtaaaagtctaaacccattagaccgcttgaaaaatagtaaaaaagaacaagtaagtagtgatgaacaaaaagaagaaactgtcgaacctgaagaaactgtaaatccagcaacacagccagaagtcgataacggtattaatcacagcacagagcaaggggcagaataatgcgtgaaaatatgatcttccaaatgttagtgctgaccttcattttcgtcatcgcttttgtcctagagattatgccttggcctgtggatttacaaggattacgcccaacttgggttgtattagtacttatctactgggtattagctctgcctgataaagttagtgtcggcaccgcttttttagcaggaattgtttgggatctgatcttaggctcaattttaggcattcacgcgttagtattgtcaattgcgatctattttgttgctaaatatcatcttatcttgcgtaatctctcgttatggttacagagcttacttgtgatggcatatatcgcacttattcgtttctttatcttctttatcgaactagtgctacatagtgcagaatttaacacccaagaaatcatcggggcgatcataagcggcatcttatggccgtggattttcttactgatgcgacatatacgccgagggctacatttacgctaatgaacagcttatctttcgatttttctgcggattttcgtcccctttccgctcgaatgcgaccacgcactctagctgaatatgtcggacaatcacacctgatcggcgaaggcaaaccccttcgccgagccattgaagcaggacatagccactcaatgattttctggggtcccccaggaacaggcaaaaccactcttgctgaaattatcgcaaatgaacttgatgccgaagttgaacgtctatcagctgttactagcggtatcaaagagatccgagaagccatcgaaaaagccaaactcaaccgacaatctggcagacgcacgttactttttgttgatgaagttcaccgttttaacaaaagccaacaagatgcctttttaccccatattgaagacggcaccattatttttatcggtgcaaccactgaaaatccgtcctttgaactgaataacgccttgctatcaagggcaaggatttacattctcaagccactacaagcggtcgatattctaaaaattttgcaaaatgccattgcagacaaagaacgtggattaggcaatgaaaagctcatcattcaagatgatgtgcttcaactgctggcggactacgtcaatggcgacggacgtttttctctcaactgccttgaattaatgtgcgatatggcagaacaattaccacaaggaaaattgctggataaagccttgctcaccgaagtgttgggcgaacgccaagcccgttttgacaaaggtggcgaccgctattacgacctgatttccgccttacataaatccattcgaggctcttcccctgacggtgcattgtactggtatgctcgtattttaaccgctggaggcgatccactgtatgttgctcgccgactacttgcgatagcctcagaagatataggcaatgccgacccaagggcaatgcaattcgcccttgctgcgtgggattgttataccagagtaggggcttacgaaggcgaacgggctatcgcccaagcggtgatttaccttgccgttgccccaaaaagtaatgccgtttacaccgcattcaaacaagccaaacgcctagctcaagaaggcaaggattacgatgttcccgaacatctgcgaaacgcaccgactaacttaatgaaatccttaggctacggtgaagaataccgctacgcccacgacgaacctaacgcctacgccgcaggggaaaactacttcccccctgaactgaaagacacccaattctacttcccaaccgaacgtggaatggaaaagcagatcaaagaaaaaatggcgtggttgaaagggttggatttgcagagtgaggtgcagaggtataacaaacaataagtttaaatttgtttactcaactcaataaacaccctatgtttatcatagctataaagaacgtggttactttgcgttttagtaaaattgtaggttaaacgaggagtgatcccccataaatgcacggcacgatgccaaattgatgcattgaagccatattctttattacgttgaataatgcggaaaatcgcctcttttttatagcgtttttgagctacacttacggaaaggcgagtagaaaaccctttgccccattcttgtccccaacctaaactaattccccgacggaaaaagctatcatctttatcacgagtagcggtgcgattgtagtttaaatttgcaaaccaatattggtttgcattggctaaataaactaacccaccagagataaagtgataattgccattgaggtgcaagcgacttgcgtaacgttgttcggcatattcatagttagtgttgagttgccatttaggtgataaccaatagtttgtttcaagggttaaaccgcctgatttagaaaaacgtcttaatgtatcactttgattagagccacctgcataaagtgtttgttccataaatggcaacagcctcaggttatattttgcattttgaaaacctagccccacactgcctcgtaagctcatttcgttgtattttttattatcccagtagtatttgccgttggtagcaagacgtagttcattaaagaagccatttccccacgaccattttttaccgagatcgaaattaaaaccgacaccttctgccgattttcgttttggtgcgtgccagttgccgtaggttgttcctgcttttggtgcattattgatattaggatcgttaagataagtaagcccacctgaaaacgtccaacgatctcgccgatttatcgcattaatgtattgatcgataagttgggtaatttcagggataagcggttctgaacgcagttttttaaactgatcttctgaagcctctaattcgttattttcaaatagggctaccgcaagttgtaaacgaacaggctgaatatctgcttgttcggcaaggatctgacgatataacttgatcgcttccgtatattgctgatttttctttgccacaattgccgatgcccatttggtgagaattggatcgtgaaattgtgcaggaagctgttggtaaatgggataaagcaattcgacattgtcaatattaccttgcattaccgcaggcaataatgctcttatcactaaatctggatattttaccaactcttttgaagtcattgtaatactactcttatccgtttcccccttagcgatttgatgaaccttaaattgatggctgtgaatgaggatatcggctttttctgcttggactctattatcatttagatgttcagtaatactatcctgagatagttttgctatagagtagttagctaagactaataaaagtgttgcactaataaacgagtgattcataacgttcctataaaagcatgaagcaatgtcaagactgttgatttttattaacaataacttaactggcgcttacattgtttgaattaatgttgtaattgtcaaacttatcagatatcatattgataatgatttttatttgattactggatttattctaatatactcatatattatgttgcaatggttttataacaggttttataacatttcgatttttttatctgtaactcttgttcatatcgggttggcatatatgatttcacaactatcttgggatagagatctcaatcattttggggacttagaaaatttacaaatggttgaagtaaatttaggaagcgaagaacccattgaagtgaaaagtgaaagtgagccagaggtgacacaagagccagagcaaatactcagtacagaagtagcagatgtttcacaagcagatctcgttaaaaaaggggagaaatctgaagtaaaagtgaaaaaagagataaaaaaatccccagaaaagctcaccaaaaaagtagagaaaaagaaagtgttatcgcctaaagcacactcagatgaaaaaacaaatacaagccaagttgcccaaaatcatcaacaaggaaatcaaaatggtgttgaagggagtaagtctgtcactggaaacgccaaagtagatgcttctcttggtgcgggttatggcaatgcaatgcgagggcgttgttcagatatttctgatgaatctgatgatgtaggcagtgtgaaattaaaggtaacaataggaacgaatggtaaagcgacaaatgtagagattttatcttcttcaggtattaaacgtttggataatcaagcaagcagaatggcatcgggacacacctatcaaccagccaaaataaataatagtgcagtggtaggcagtgtgatttttagtattcattttaaatgtggggcagcagcctaaattatttgaggtaatttatgaatttaattcaacttcttcaacaacaagatattgtactttccatttcctttggaattttagttgtaatgagtattttatcttggactattattttaattcgtttaattaaaatgattggtgtaagaaaaaataaccaacaaagttttaaattagttaaatctgctgaaaatcttactcaagcagagcaatatattcaaaacaagcggtctgaaattgcagatattttacagctaacttttaaacaatgtgaattatatcaagctaaagaaaagaaccatttatctcatcaacttccatttaaagatttcctgacattgcatttgcgaaatgccatcactcaatcgttgcgtaaatatgatggcggtttagttgcattagcttctattggtgcggttgcccctttcattggattgtttggcacagtctggggaatttttaatgcacttatggatattagtcagcaagggcaagtcagtattgcaaccgtatctgcccctataggtgaggctttagttgcaacggcaatgggattatttgtcgccattcctgcggtgcttgcttataacttaattactcgccttaatcgtaatctttctcaagatttagatcattacgcaaacgagttatttatctatttattacatcactatggagaaaataaataatggcatttggaagttttgataaaaatgaaaattcggtaatgtcagaaattaatgtcacgccattagtagatgtaatgttggtgttattaattgtttttatgatcacaatgcctatattaacgcaatctatcccgcttgaactaccaaccgccaatgttgagaaaaaagatgaagcaaaagatattttcagggtggcgattaatcctactggcatttatttaggcgaaaagctagtgaatgaagaagaattaaaacaatcttttctgacaaaatttcaggaaaataaaaataccgttattgctatttctgcggatatttccgtggaatatcaacatatcgtgaaagtccttgaattagctcaaaatgttgggctaaccaaaattggctttgtaacccaaccaactaaataaatgcagtgtttttatatcggaggcaaatatgcattttaaacttaatccctatgcgttagcgtttacttcgctgtttattgtcgcttgttctggcggaaaaggaagttttgatttagaagatgttcagcctaataagacaacgggcgtgtctaaagaagagtatcaggatgtggaaacggataagaaagtaaaagaacagttaggggaattgatggaacctgctttggggtatgttgtaaaagttccggtgagttcttttgaaaataagaaagttgatatttcagatatagaagtgattacgaacggaaatttggatgatgtgccatatcaagcaaattcttctaaatatagctatccagatgtaaaaacaaaagattcttctcttcagtacgttcgctcaggatatgttattgatggggaacactctggttttaatgaaaagggatatgtgtattataaaggtaattcacctgcaaaagaattacccgttaatcagcctttaacttataaaggaagttgggattttacttccaatgcgaatttaaataatgaagagggaagacctaattatttaaacgatgattattatactaactttataggtaaacgggcagggttggtttcaggagatgcgaaaccttcaaagcataaatacactagccagtttgaagttgattttgcaactaaaaaaatgacaggtaagttatccgataaagagaaaacgatttatacagtcaatgctgatattagaggcaatcgttttacgggttctgctacagcaagtgataaaaacaaagggaaaggtgaatcatataacttctttagtgtcgattctcagtctttagaaggtggtttctatggtccaaaagcggaagaaatggccggtaaatttgtagccaacgacaaatctctttttgccgttttttcagcaaaacacaatggctctaatgttgacaccgttcgtattattgatgcctcaaaaattgatttaactcattttaattcttcagaacttaccaattttggcgatgcttccgttttaattattgatgggaaaaaaatggatctggcaggtagcgggtttacaaataagcacactattgaaatcaatggcaaaacaatggtagccgtagcctgctgtagtaatctagaatatatgaagtttggtcaattatggcaaaaagagggcgaaaaagctaaagataatagtttattcctacaaggcgaacgtaccgcaacagataagatgccaaaaggcggaaactataaatatattggtacttgggatgcnnnnnnnnnnnnnnnnnnnnnnnnnnnnnnnnnnnnnnnnnnnnnnnnnnnnncgggctatcgcacagaatttgatgttgattttggcaacaaaaatttaagcggtaagttatttgataaaaacggtgtaaatcctgtatttaccgtagatgcaaaaattaatggtaatggttttaccggaaaagctaaaacctcagatgctggcttcgctctagactcaggcagttcacgttatgacaatgtgaaatttagcgatgtagcagttaatggtggcttctatggtccaacggcagcagagcttggcggacaattcttccataaatcagacaatggcagtgtaggtgctgtctttggtgcaaaacaacaagtaaaaaaataataaggaatttgctatgaaaaataaattaaatcttattagccttgctcttcttagcctctttgccgcacaaagctatgcagaacaagcggtacaattgaacgatgtttatgtcacaggtaccaaaaagaaagtgcataaaaaagagaacgaagtgacaggcttagggaaagtggtgaaaacgccagactcactcagtaaagatcaagtgttagggatgcgagatctgactcgttacgaccccggtatttctgtagtagaacaaggacgaggtgcaacaacaggctactccattcgtggggtagatcgtaatcgtgttggattggcgttagatggtttgccacaggttcaatcctatgtaagccaatattcacgttcctcaagcggtgccattaatgaaatagaatacgaaaatctgcgttcaatccaaattagtaaaggggctagctcttctgagtttggtagtggctcgttaggtggttcggtgcaattccgtaccaaagaggtaagcgacattattaagccagggcaatcttggggattggataccaaaagtgcttacagtagtaaaaatcagcaatggctaaactcacttgcttttgctggtacccataatggctttgatgcacttgtgatttacactcatcgtgatggtaaagaaacgaaagctcataaggatgcggaaagtcgttctaagcgtattcaaagagtggatctcgcagacaataatcctcaagatagcaattggtttaaagttaagaatgattgtccaagtttgaactgcgaaccacgtcagcaggctaaagtgtcttatgatgggcaaaagtatctaacagagcaacttagtgctaaagaatatacaggtgaagaacgagctttgcctgatccagtgaaatataaatctgattcttggttggttaaattaggttatagcctttcaccaaaacattatgtggctggtgtttatgaacatagcaagcaacgctatgatactcgcgatatgacctatcctgcttattggcagctatcagatttaaaaaatggtaatacgtggtatccaatgaataatgctaaagggttatatcgtagtaatgctttagatggtgttgctattgattactttacagaagatggtgtgaaatcctcaaaaggattacgttgggcaaaagctcgttttattgatgagtggcacactcgtgatcgcttaggtgctttatatcgctataccaatcaagataaagatcgtctgattgatagcctctctttgagtttcgatcagcaaaaaattgatttatctacccgcttgagagagaacaactgttccgaatatccaaccgtagataagaattgccgtgcaacccttgataaactttggtcttccactaaaaatgagcaaagttcttatgaagaaaaacacgacaccattcagctctcgttagataaaaccgtacaaacgggattgggcaaacatcaattaaatatgttattaggttcagaccgtttcaattccaccttaaaacgtcacgaaattttgagtaagttttctgtgggaacttggcatcgtatcagtggtaacggtcataaaaatacaccttacatctatgagctaaaagatcaggcaatttatagtaaaaatgaatgtaattatagtggcactattgcaggcagggctgattgtgctacaagcaaaatcaaaggacataatcactacatcgctctgcgagataattttgccataaccaaatatttggatattggtttaggctaccgtttcgataagcataaattccgcagtactcaccgctgggcaaatcaaggcgattataaaaacagtgcgtggaatgtcggcgtagtcgctaagccaacttcattcctatcactctcttatcgagcatcatcaggctttagagtgccaagtttccaagagctatttggcttacgctatgatggtgcaatggcaggttcgagcgatgcttaccaaaaagcagagaaattatctcctgagaaatccttaaaccaagagattgcagcaacattcaaaggtgattttggtatcgttgaagtcagttatttcaaaaatgactataaacagttgattgccccagcagaaaaaatgcaccaaactcaatcaatgattaactatttcaatgtgcaagatattaaattagacggtattaatctgattggtaagttagattggaatggggtatttgataagattccagagggcatttatacaacattggcatatagcaaaatgcgagtgaaagaggtgaaaaattatcctgggtatatgaacattcgtaccccattgttagacaccatccagcctgctcgctatgtcgtagggatcggttacgatcaaccagatgaaaaatggggcgtgaatctaacaatgactcattccagcggaaaaaatccagatgagttaagaggtaatgaacaagtcggttttgccaattatgaacgaactgctacgaaaaaaagaacacgctcttggcatacctttgacttaacaggatatgtcaccccttggaaacatgtaacggtacgagcgggtgtatataatctgatgaattaccgttacaccacttgggaatccgtacgtcaatcttcgcttaatgcgattcatcagcatactaatgtgaaagattacgtaagatatgccgcacctggtagaaactatgtcctttcagtagagatgaagttctaactttctatagagcatggaataaatttgtgtaaatacctgtttctgtgataatacatctagatacaggtatttttataggtgagcaggaattcggcatatcatacgacaagtgttattgaatctctaggtgatgtaatccgtcgagtaattaaggaaagaaatgtatttccaattgatgatgtgacattttaaatagcatagtttttggcagatcagcaaacaaatttgcctacttgccgcaattaatgagatggcaaaaatgaagcatgctaactctaaactagaaacagccagcttattgattttggtgatcgcctaagcgaccaccataagtttaaaatgaagatacttagaattagagatagatgtacaaataacagcgcttggatatgttatctcagatacaaatatttacgccatctataatgcttcattcgcttttttaatactatcatctgctctgcgtgcttcacctttatgtttttgtttatttaactgggtttcaagttttgattctacttcgttgatagctttatagagatcttcatcatgtgcttttgcaaataaatcgccaacaggggttccaatagaagcctcaacttcgtaaccatttggtaatttgtggataataaagtgagggttaattaactgagtttgccatttattcagtttagccaaacgctcctcaatgtgcgtacgaattgcaggggtcacttccatttgtttgcttgaaatattgattgtcatagcatgtacctcttttattatgaccttgttggtcgttgaatggatgacttcaaattatgcctttccccctaaaatttcaacccctaaagttaaacaattttcaaaaacttgatctacttaacacttttctggtttttttgactataattccaacgatatttgtgagaggtatttatgttatcagaaactcgcttggcaaaaattcatgaaatggaacagattttaaatgaagcaaatagcctaatgaataaaatggaacagcttcaacagtcgtggatagttcttttaccaaaaatccgagagctagaaaattattatgctgaacagtggcaagaagattataatgctgatgaacgaggggaaattccctcagagatgattcgaggcgtattaagtgaagatgccgtgtataatttattcattgctcatcgagaaatcgcactggagtggattcgcttgtcagtgaaatcaatggaaacaacataatgatagataaaccacttcctccttttcagcgagcctttttacatccaaagtattggggtttatggctaggattgggaattttcaaactgattttatgcttaccttaccctattttagcgaaagtcggtaagggcttaggtaaactgtttacccgattaggtttggataaacgccgtatgcgaattgccaaacggaatttggaactttgcttcccagattataccgcttgtcaaattgatgaaattttagctcaaaatgccgaatctgtcggaatggcaattattgaaacagggatggcgtggttttggtcagatgaacgtattcttaaatggtcgaaaatagaaggattggaacatctgaaaaatcagcctgagggttcggggattatttttgtcggtgttcattttctgacccttgaacttggggcaagaattgtcgggcttcatcatcaagggattggcgtatatcgtccgaatgataatccgctgttagattggattcaatttcgtgggcgagtacgttctaacaaagccatgctagatcgcaaagatttacgcggtatgattaaagctcttcgtgcaggggaaaccatttggtatgctcccgatcacgattacggacgcaaaaacagcgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgtgccgttttttgcggtgaaagaagcgtgtacaacagctggaacgagaatgttattacgttccgccccaaatagtatcgttgtgccatttaccccaatgcgaaacgacgatttttcaggttataccgtcaaaatcaggcctgcagtagattttagccagtgcaaaaatgacgttgatactgcaaccttaatgaacaaggtcgtagaaagcgagattatgcaagctcagagccaatatatgtggctacatcgtcgttttaaaacccgaccgaatgagagcgatccgagtttgtattaaaccgccgacattaaacctagtagggacgccacgcttggcgtcctagaaaacaatttttaaggtagcaactgtgtttgtgaatgctcatagtttcagaaatttcaatatgaggaaagagatagtgaacaaaaccaaaattgtccttgccacaggcaatcaaggaaaagtgaaagaaatggctgatgtgttagctgaatttggctttgaagtaatcgcccaaagtgaatttggcattcaaagcccagaggaaacaggcttaacctttgtagaaaatgcattgattaaagcccgttatgcctcacaaatgacaggtttaccggcgattgccgatgactctggtttagcggttgaagcattgggcggtgaaccagggctttattctgctcgttatgcaggtgaagaagggaacgatcaagccaatcgccaaaaattattggctgaaatggcaaatgttgccgatgaagatcgcacggcaaaatttgtcagttgcattgtgatgttacaacacccgaccgatcctaccccgaaaattgcgataggcgaatgttacggacaaattttacgtgaggaacgtggttcaaacggttttggctacgatccactctttttctatccgcctaaaaactgcacctttgcagaactcgaaaccgtcgagaagaaaaaaatctcccatagagcgattgcattacaatcccttaaacaacaattgaaataggaacattatgattattaccacaaccccaaatattgaaaaccatcaaatcgttgagtacaaaggcttagtttttggtgaagtcgtgtcaggtgcaaacgcagttgtcggtgtgtccatggaatatcaatcgatgggcggtgacaaaggtatgtttattgtagttgcgactggctcagcggttgtgattagttaatgttgcaaaaaaatcttcaaatcacaccgcttttttggcaaaccaaaactctgcttgaaatgaatgaagcagagtgggaagcgctgtgtgacggctgtggtaaatgttgttatcgcaaatatattcaaggcagaggcaaacgggaacgactgtattacacgtccgtcgcctgtaatttgcttgatgtgaatacaggacgttgtactaactatgctgagcgtttcaaaatcgaaaaagattgtaccaagctcaccaaaaagaacctacccgattttggctggttgccgaaaacctgtgcctatcgactgatttatgagggcaagccgttgtttgattggcacccactgatttcacaagatcccaattcagtaaaaagagcaggggtgttaatccccaacggcattcacgaaaaagatgtgattgattggtttgagtttgtgattgatactgtataaatctcaatatggttagtattctttatgagtaatttaaattacttttaaagttctaacaaatacgccttcaactccctaatcttatccctcaccgctgccgctttttcaaactctagatctttagcaaaatctcgcatctgttgttcaagcactttcaattctttttctaactctttacgagattttggaatgtaagcggtctgatcatcgcttgattttgcagattttttactgcgttttggtttatctgtctgcccaatatccaacaactcgccgacttttttgttcaacgcttgtggcacaatgccgtgttcttcgttgtatttttgttgtttctctcggcggcgttcggtttctgtgatcgctttttgcattgagttagtgatgcggtcgccgtataaaattgctttgccgttgagatttcgggcggcacgtccgatagtttggattaaagaacgttcggaacgcaaaaagccttctttgtcggcatctaaaatcgccaccagcgacacttctggcatgtccaagccttctcgcaacaagttgatcccgactaacacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccgactaacacatcaaacattcccattcgtaaatcgtggataatttcgacccgctcgactgtgtcgatgtcgctgtgtagataacgcactcgcacgccgtgttcgtctaggtagtccgttaaatcttccgccattttttttgtcagcgtggtgactagcactcgttcatctaccgccacacgcttatgaatttctgacaataaatcatcaacttgcgttgccacagggcgaacttcgataatcggatctaacaagccagtcggacgaaccacttggtcgattacatcaggatttttctctaattcgtaaggtccaggggttgccgatacatagattgtctgtggcgataagcgttcaaactcttcaaaacgcaacggacggttgtctaaagcagatggcaaacggaaaccgtattgcaccaaagtttcttttcttgctcggtcgcccctaaacataccgccgatttgtggcacggtaacgtgggactcatcaataatcagcaagccattagacggcatataatcaaacaaggtcggtggcggttcaccctcttttctgcccgataaataacgtgagtagttttcaatgcctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctgagcagtagcccaactcgttcatcatctcaatatcaaactgggtacgctgggcgatccgctgttcttcgagtaatttattctctttgataaagtaagttcgacgctcggcaagttcttttttgatctgctcaatcgcttctaaaatccgatctctcggagtaacgtagtgagtttttgggtagatcgtataacggggaactcgccctaaattatgccctgtaagcggatcgaataaggacagattttcgatttcatcatcaaacagttccacacgcagagcgacaccgtccgattcggcagggaaaatatcaatcacttcaccacgcacacggaaagtcgcccgctgaaaggcttgatcgttgcgggtatattgcaattcagcaaggcgagagagaattttgcgttggtcgatcatctcgcccacttgcaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggtcgatcatctcgcccacttgcagatgtaacatcatctgcatataggcatctacatctcccaagccgtaaattgccgacaccgatgcgactacaatcgtatcccgtctttctaaaaaagatttggtggcagacagtcgcatctgttcgatctgctcattgatagacgcatctttttcaataaaagtatcgctggcaggcacataggcttcaggctgatagtagtcgtagtaggaaacgaaatactccaccgcattttcagggaaaaaggctttcatctcggcataaagttgtgccgcaagggttttgttcggggcaagcaccattgctggacggtttaaagtcgcaatcacatttgcaatggtaaaggttttgcccgatcctgttacacctagcaaggtttgatgtgccaagccatcattcaatccctcgactaatttggcaatcgcagtcggttggtcgcctgagggtttgaagggggaatgtaaaataaatggtttaccctgtttgctcattgaaaatccttgtctgaaaatttgctagaattctaacatagaataagtggtgagattttgggaatttcagcctaaaaagaaattttgttattcatacaatttactttaaaaatcctctttggtggacgctcagaaatccattacaattcttcgtaaaataatgctaaaactcaccgctatgattgatacacaaactttaaaaacagaacttcagcaatttaatagcacacaaaaatccctttttagtactgaagatatcaaaaatttactcgaacaacgtagccatttttatgatgatttactgacaacgctctggcaacaatttgggttgatggagcggcaggacttggctttagtggcagtcgggggatatgggcggagggagatgtttccgctgtctgatttggatattttggtgttgagtgaacagcctttagatgaacagacgcaaaatcaattaaatcaactatttaacctcttgtgggattgcaaatttcagctgggggcgagtgtgcgaaccttggcggagtgtgttgaggtgggcagagcggaaatttctgtggcaacgaatatgtttgagagccgttttttgcttggcaatgaagccttgtggcaacagctgatgagcaagctgttccacgcggagttttggtctattcaagccttttttgaagcaaaaatggcggaaaaaaatgaacgttatgcccgttatcataataccagttataaccttgagcctgatttaaaacatagtccgggggggctacgggatttgcatttgctctcttggattatgttacgccattatgggctatatagcctagagagtttgtttagtcggggtttgctctatcctgaagaatttattgagcttcagcaggctcaacatacgttatttagaatgcggtttgccttgcatttgcaattaaagcgttacgataaccgcttgcggtttgatcgccagttacaactgagtgagcagttaggctatcagggcgagggtaatcagcctgtggaagcgatgatgaaagatttctttcaggcgacgcaatctatttcgcaattaacgcaattgttgctcaatcattttcatcaagaggtgctacaggctttgcaaaatgtacagcaaaaacagccgcttgatgactatttttatttgcaaggggaacagctaatttgtagtaacactttgatttttaagcaacaacctgagcggattttggatcttttcttctatctcactcagcatacgcaggtgtgtgtagccagtacgacgttgcgacaacttcggctggcgttacagaccttaaaccagccgttgtgtgaactgcctcaagctcgacatcgctttattcggctgttttctcagcctgatgtggttaaaagagccattatgccaatgcatcagttgggcgttttaaccgcttacttaccgcaatgggttggtattcaaggcttgatgcagtttgatctttttcatatttatacggtggacgagcatacggttcaggtgatgcttaaattagaaagttttctgcaacaggaaaatgccgaaaaacatccgctttgttgtcgtctgtttccgacactggcagaccgtccgttgctctatttgtcagccttgttccacgatattgctaaaggcagagagggcgatcacgctaaagttggggcggaagatatgcgtgcttttgctcaacaacacggcttttctcaagagcaaagtgattatatggcgtggttggtggcagagcatttgacgatgtcaattacggcacaacgtcgggatattcacgatcccgatgtggtgaaaacttttgcaaatgtggtgaaaaatccgaccgctttagctgctttaacctgtttaaccgttgcggatatttgtgcgacgaatgaaaccctttggaatgattggaagcggtcgcttttccttaaactttttcaatttaccgaacagcagttgcagttaggcagtgaggaaacgattaatcatcagcaactgagccaagcccatcaacagcaagcctatgtacaacttgaggcgttactttcggctgaacaaaaaacacggctgttgcaattttggcaatcctgtcctgaaagctattttgtgcgaaacagcccgacacagctttattggcacgccttgcattatttaaaagatcctgcgttgccgatggtgttgattagcaatcagtatgcacggggagcgacagaaatttttgtgcattgccaagaccaagcccagctttttgcgagaattgcacagacgttaagtcagaagaaagtgagtatccacgatgctcaaatccttacgagcgatcatggtttggtgttggatagttttattattacggaaatgaacggcgagccactcgatgatgagcgaagtgaacaaattcagtcggcattggttaaaactttgcttgcgaatacggagaaagtgtttaatccaagtaaaaaatccgttaaacatcaggcgtttaagcgaaaaaccaagatccgttttttagcaaattcccagccaaatcagaccgcttttgagctatttaccttagaccgagaggggttgttggctcaaattgggtatattttcgggcagcttaagttgaatttgattaacgctaaaattacgaccattggtgaacgggtggaggatttttttgtggtgagcaatcagcaaaatggggctttggcggaggaagaacaggcgatgttgaaacaacatttgttggcgatgttagaacaagaatagaatgctatactgtctatcaaacaatgaattaagagtaaaagatgttattgttatattcagtattagtaaaaaggtaataaagaatgctactcgcacaagaccccgaacagtttcgagaatctgcgtatttacgccaattttggatagagttgaggaaagacacctttgcactcatcagccttaatctctttattcttctgatgggattggttttttttggctatttacttgccccttatgcagccgatcggcaatttagcggaatggaattaatgccaccatcgtggagtgatagcggtcagattagccatttttttggcacagacgatctaggaagagatattttcagtcgcgtcctctacggcttctactacaccgttggttcagcattggtcattaccattgctatcggtattttaggtggcattcttggcgtgattgcagggacaaaacggagtggatctatttttattctcagtcatctttttgatacctttttatttacgccgattttgctgattgccatcatcattgcaactttaatggaggtctcgctcattaatgcaatgttggccatttttcttgctatgttgcctcactttatccataaaatttatcaaacgacccaacgggagctggcggagaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctggcgagagaatatgtcatcactttaaaattagagggtgcaagaaaacgagatttaatccgtgaagtgatcttacctaatttaactgtgattgccgtcaaagaacttgcgcatatttttgttattgccgtgttagacatcagtgcattgagctttatttcactgggggcaacgagcccaacgccagaatggggagcgatgatccgcgattctcttgaattaatttatgttgccccttggacggtcattcttcctggatttgctatcatttttactctacttatcattacaatgcttggaaacagcattgtacgggtgcttgaaaaatatcgttattagggaagggaaacaatggcattactggatattagacatttaagtatcgaaattgatacgccaaacgggcgtataaaaatggtagataatatcaatcttacccttgatagcggtgagatatgtggtttagttggcgaatcagggtcaggaaaaagtttaattgctaaagtgatctgcggattagtcaaagacgagtggatcattactgccgaccgctttcgctttaacgatattgaattactgaaactttccccctatcagcgccgaaaactggttagtgatcagatttcaatgattttccaagatccactctcttgcttagacccaagcgaacgtattggtaaacaattaatcgaaactatccgctttaaaggcaagtggtgggaacgttttggctggaaaaagaaaaaagccattgaattactacacaaagtggggataaaagatcataaagatattatgcaaagctatccaacggatattaccgaaggtgaagcacaaaaagtgatgattgcaatggcagtggcaaatcagcctcgcttgctcgtggctgatgaaccaaccaatacaatggaatcgaccacacagctacaaatttatcgcttgctttccagtatgaacaaaaatcttggtacgtctattattctagtgagtaacgatatgctcagtatttacaagtgggtagattcatttaacgttttgtactgcgggcaaaccgttgaaattgcagagaaagaaaccattatggaaaccccttatcacccttataccgcagtactattgcatagcctacccgatttttctaaacctttgccttttaaaggtcgcttgaatacccttaaaggctcagttccaatgttacaagatatgcctattggttgccgtcttgggcctcgttgcccttttgcgcagaaaaaatgtgtcgttaaaccaccgctacgcaaattccgccaacacgaatttgcctgccattttccgattaactttagagaacaaaatttcttacgtaaggaagaatttgtgccagtgatcgtaaaagtagattagatgttatatagcttagtccatattaatgatgatagaaaaaagtctatatcggtatttaatactcgaatatataattggtcttaatttagaaaaatcccttttcgatcaaatatcctttaaatttttgcgaagctcatcacttttttacaagacaaatttgtaaaatcccattaccatatgcaagtcttttcaacattaactattaactctcatagaggatattaacaatggcaaaaatcgttaaagtaattggtcgtgaaatcattgactcacgtggtaacccaactgttgaagcagaagttcaccttgaaggtggttttgttggtttagcagcagcgccatcaggtgcatcaacaggttcacgcgaagcattagaattgcgtgatggcgacaaagcacgtttcttaggcaaaggtgtattaaaagctgtttctgcagtaaacaacgaaattgctaatgcaatcgtaggtaaagatgcatctaaccaagctgaaatcgaccaaattatgatcgacttagatggtacagataacaaatctaaatttggtgcaaacgcaattttagcggtttctttagcaaacgcaaaagcggctgcagcatcaaaaggtttaccactttatgctcacattgcagagcttaacggtactccaggcgtgtactctatgccattaccaatgatgaacatcatcaacggtggtgagcacgcagacaacaacgttgatatccaagagtttatgatccaaccagtgggtgcatcaacattaaaagaagcacttcgtatcggtgctgaagtattccacaaccttgctaaagtattaaaagcgaaaggcttaaatactgctgtgggtgacgagggtggttttgcaccaaaccttgcttctaacgcagatgcattagcttgtatcaaagaagcagtagaaaaagcaggttatgttttaggtaaagatgtaactttagcgatggactgtgcgtcttctgagttctacaacaaagacaacggtttatacgaaatgaaaggtgaaggtaaatcattcacttctcaagaatttactcactacttagaaggcttatgcaaagagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatgcaaagagtacccaatcgtgtctatcgaagatggtcaagatgagtcagactgggaaggttttgcataccaaactaaagtattaggtgacaaagttcaattagtaggtgacgacttattcgtaaccaatactaaaatcttaagccgtggtatcgaaaatggtatcgcaaactcaatcttaatcaaattcaaccaaatcggttcattaactgaaactttagcagcaatcaaaatggctaaagatgcaggttacacagcggttatctcacaccgttctggcgaaactgaagatgcaactatcgctgatttagcggtgggtacagcagcaggtcaaatcaaaacgggttcaatgagccgttcagaccgtgttgcgaaatacaaccaattaattcgtatcgaagaagcattggcagcagcaggtacaccagcacctttcaatggtcgtaaagaagtgaaaggtcaagcgtaatttgcgttgatttattgaatatagccaccttgagaaattgaggtggcttttattagctatgtgtcataaaacttaccctttcgggcggagatataaggtacaaatagcgtaagttatttcaatcttgttaagtttgtgattacttgataataagtgttcagcagaaagagctcaccgagggtagcctataataatcaatcggagctagttggagccttcgtctttaaagacttggacgtcaacaattcttcaatctaataaaatacatcaagaaatcttataagaattaatttcatagtttgtggaatactatggtagaattgcgaaaaaactctgatttgatttcatagaaggagaataagatgccatcttttgatattgtttctgaacttaccatacatgaagtacgcaatgcagtagaaaatgcaaatagggtattaagtacacgttatgattttcgaggagttgatgccacaatagaacttaatgaaaaaaatgaacttatacgggttactacagaatctgattttcaacttgaacagttaattgaaattttaataggatgctgtattaaacgtggtattgaacatacttccctagatattccttctgaaagtgaacatcatggtaaactttacacaaaagaaattaaattaaaacaagggattaagtccgatatggctaagcagcttgttaaacttattaaagactctaaaatcaaggtacaagctcaaattcaaggagattccatacgcataacaggaaaatcccgtgatgatttacaatcgacaatacagcttgtgaaaaatgctgaattagggcagcctcttcaatttaataattttcgtgattgattttccatatatatcttctttcatttaatcaatataaagaatcttttcattgaatctaatcgctcaaacttactagagtgatttctctgttttcctataggctgtaaagagatacttatgtcagaaaaacgctacggtgctgatgaaattaccgttctcaaagatcttgaacctgtgcaacttcgcccaggtatgtacactgataccactcgtccaaatcacttagggcaagaagtaattgataacagtgtcgatgaagcgttatcaggttttgctaatcaaattgatgttatcttacatagcgataattcccttgaagtcgttgataatggacggggtatgcctgtggatattcactcgactgaaaaaatttcaggggtggaacttatcctaacaaaactgcacgcaggcggtaagttctctaataaaaattacaccttttcaggcggtttgcacggtgtagggatttcggttgtaaatgccctttctgaaagtgttgagatcaccattaaacgtaatggcgagatttataccattgcttttgcaaatggcgttaaagtggaagagctgaaagtgatcggttcttgtccaaaacgccaaacaggcacaacggttcgcttttatccaaatccaaaatattttgattcgccgaagttttcggttagtcgcctacgtcatctattgcgagccaaagcggtactttgtccgaaattaacgatcaattttaccgaccatatcaataatacccaagaaacgtggtactacgaagatggcttgcgtgattatttaacagatgcattgaaagaatatgaatatctgccaaatcctctttttgttggtgaagtgattggggaaactgaagctgtgagttgggcattaagctggctcacagagggtggcgagcagattaatgaaagctatgtaaacttgattccaactgcacttggcggcacacacgtcaatggtttgcgccaaggtttatttaaggcaatggctgaattttgtgattttagaaatctgttgcctaaaggtgtcaaattaactgccgacgatgtttgggggcgttgttgctatgtgctatcacttaaaatgcaagaaccacagtttgcagggcaaaccaaagagcgtttatcatcacgacaagcggcgagttatgttgaaaatagtgtaaaagatgcttttagtttatggctaaatcaaaacgtacaggttgctgaacaactggctgaaatggcaatcagttctgcacaaaatcgccttagagccgaaaaaaaagtcgtacgaaaaaaattggttagtggccctgccttacctggaaaattggcagattgtatttcacaagatttaatgcgtactgagctattccttgtagagggagattctgcgggcggttctgcaaaacaagcgagagataaagagtttcaagcgattttgccgcttagaggtaagattctcaacacttgggaagtatcacctgatcaagttctcgcgtctacagaagtgcacgacattgctgtcgcattgggcattgatcctgacaatgaagatataagccaactacgttacggtaaagtttgtattcttgctgatgcggattcagatggtttgcacattgccacattattgtgtgctttgttcctccgccatttcccaacattagtaaaaaatggccacgtttatgttgcaatgccgccactttaccgtattgatattggtaaagatgaggtgcattacgcattagatgaatctgaaaaagaggctattttagctcgtcttgcaaagaaaaaaggaaaaccaaatgttcaacgctttaaaggtttaggtgagatgaacccaagtcaattgcgtgaaacgacaatggatccaaatacacgacgtctagttcagctaaccttagaagataatagcgatgatgaagaggtttcaacctttgaattaatggatatgttgcttgctaaaaaacgggctgaagatcgcaaacaatggttacaagatcgtggtgatgaggcggatttataaataaaccaaataaagattggcgttgaaaattaatagtatttttttattaattcaatagttttacaaacttataactatcaatgataatactcgtaacctattaataagctatttttggaggaaattcactatgtataaatgtccatttgatcacggatcaaaaaccttaacaacagcagcaggcgcccctgttgttgataatgacaacacaatgtctgctggcccacgtggtccacttcttttacaagatgtatggtttcaagagaaattagcacactttgctcgtgagcgtattcctgagcgtgtggttcacgctaaaggttcagcagcttacggtacattcactgtcactgcagatattaccaaatacacaaaagctgcagtatttaaaccgggagcgcaaactgaagtattattacgtttctcaactgttgctggtgagcgtggggctgccgatgcagagcgtgacgtgcgtggtttttcattaaaattctatacagaacaaggtaactgggacttagtgggtaacaatacacccgtattttttatccgtgatccattaaaattcccggattttatccatacacaaaaacgtaatccacaaactaacttgcgtgacgcgaatgcagcgtgggatttctggtcacgtcaccctgaatcaatgcaccaaattatgacattgttctcagatcgtggtattccagcgactttacgtcacatgaacggttacggtagccacacctatagctttgtaaacgcaaacaacgagcgtttctgggtgaaattccacttcaaaacacaacaaggtcacaaattcttcactaacgaagaagcagctaaagttgtaggtgaagatcgtgagtctagccaaaaagatttatatgaagcgattgagcgtggtgaattcccacgttggactgttcaagtgcagattatgccagaagcagatgctcacaaacataactatgcctttgacttaactaaagtatggccacacgcagattacccagtgatcgaagtgggtgtattagaattaaaccgcaacccacaaaactacttcgcagaagtagaacaagcggcatttgcaccatctaacatcgttccgggaatcggcttctcgccagaccgtatgttacaaggtcgtctgttctcttaccaagatgcacagcgttaccgtttaggtgtaaaccaccaccaaatccctgtaaatgcaccaaaatgcccataccacacgactcaccgtgatggtgcaatgcgtgtagatgcaaacggtggcaaccaccctaactatgcaccgaaccgttttgacacttatgtgccaacccacgatcaattaccattacaaattgagcgtgaagccgcacactttaacttccgtgagtacgatgaagattactactcacaaccagccgcactttacaacttgttcacagcggaagaaaaagatcgcttagcaggtaactttgcagcaggtttatcaggtgtaactattcctgaaatcgtggaaagacaaatggctcactttgaaaaagttagcctagaattagcaaatgcgattcgtcaaaaattagcaaaataagctaattaaagacttattttctccttacacttgtatttgctatactttaagcccaaccgttttggttgggctttttttcttggaaagaataaatatggaataccgctattacattatcacaaccgtttcagttatcgcccttcaatttctgctcttttgcttttctaaaacagcaacttggttaggcgatctatcaaatagaagtcgtaagatcgttacattttctatctatatcgttgcaaatctgttgataatattgcacgttacacgcattttgccaaacttccgcttaattgctttaatactcacattacttttatttatcttcttcatcagcttctgtttttgggggatttatactgtcggcaaacagatattctcgccgaatagccttaatcgctggcttaaaataagctatatccctgttttattcgggttaattgggctgactatttacaacgcctattcaaccaaagtggtgcattatcaagtcacattagataaacctatacagccacttaaaattggcgtcgccagcgatttccacttagggaaatttttcggggggaaacagctagataagttagcaaccatctttaatcaagaacaagttgatctaattttgctccctggcgacattatggacgataatgttgaagcctatttggcggaaaatatgcaaccgcatttggcaaagttaaaagcaccgcttggggtatatgctacaatgggaaaccacgatttttttggggctgaagctgaaatttatcaagaaatcactaaagctggcattactgtgctatgggatcaagcggttactttagacggaaaatttacgatcatcggtcgtaatgatgaattagtgaaaaatcgccctgaaacagcagagttattggctctggtagataaaaatttacccgttttcctaatggatcaccgcccaacacaaattgagcaacatgctcaactgcctattgatattcaagtgtcgggccatacccataatgggcaaattttcccagcgaatatcattactcactttatttaccgacttgctcacggttatgaaaaaatcggtaatggacatttttttgttacttcgggatacggattttgggggataccgatgcgactaggttcacagtcggaagtgatgattattgaggtgaaagggaagtaattacacaaagcacaattcaaggctactttttagggaccattttgcctgttactccctatgttttaaatgacgctatcccaacaacgccttcaaatttgctttcatcttatccacttgctctgcataaatctgtttcttctctaattcatcgatcaaataatgaatggtttcagacaaggtcagatccatttctttggcttgcttggacaggcgttgccagctggcgtattctaaatcgatagattttttacgggtagattgcttttcggcattgaaaaaacgcttgcgtcttgctcgaatagattgacgcattttcttgcgttgctcagatgtcatttccgccttaatccattgctcgatctcttcgggcgagttttgtaaggtggttaataattgaactttcaattcgatcaagctctgttcgtcgtatttggtgatattttcgccttcacgatattttttcagcaagtatttccatttccaacttgcttcttgaatttcaagtttttggtatcgcattttgcctccgaattatttgtgaagtatagcgtaattataggtataatgaagcaaatttctataaagaggcaaatttgtgcaagtatctccattatcgttgcaatcattaagcgttcactatcctttcaaacagaccgatcaagcggtgagatttttggattttcaaccaaatacacagcaggcaatgcaacaatttgccctgagtgaatttggttcggcactcattttgaaaacggaattatttcccgaatttttaaatgaaatcacggactattttgaaaatttgcattgtcaaactgtgttgaaaacagaatttaatcaccaaagtttatttggatatagcctttatttagaaaaggaaaaccaaattaaaacggtggcaggggcgattgagcaagctcatcagggtattcttattttaaatgtgagtgcattattattagatattgtacaatgggataaattaaaacaagctctgttatttgggcagtttgatcctattattgcaggtaaattacctgaagcaattatgcctattcaatctcaattcaaattgatattagtaggtagtcgagatgatattgcaacgttacataattatgatgaagatttatatcaattttgccaatatgctgaaatcgagtcgtatttgaatattgatgaagaaaatagcgaacaatggggaagctatattcaatcttcagctaaaaaatatctaaatagaaccttttctaaaacaggtttaaatcagcttttacattattatattcgtgaaagtgaaaaccaaacattaatttctatttcaccgacattattaaaaaaacatttattaggattacaacatttttatccaaaacaaacccaatttaaccatattcaagattattttgattatttagaaaaacaatctggtgtattaaataaatttgttttaaatgatattttaaatcatcagctttatattgaaacggaagaagaaaccatcgggcaaattaacggcttatctgtggtcgagtttgatggcgttccccatagttttggtgagccattacgcattagctgtaacgtgcaatatggtgatggagaaattcacgatattgaacgcaaagtggagctggggggcaatattcactctaaagggattattatcgctcaatcttgcttggcaaatttactggaattaccgacacagcttccgttttcagcgtccgttgcctttgagcaatcttatggtgaaattgatggggatagttcatcgttagccattttctgcgtgcttatcagtgccttaaccaagttgccgttgccacaatcccttgcggtgacaggggcgattgaccaatttgggaatgtgttaagcgtgggcggtgttaatcagaaaattgaaggtttcttcaatgtttgtgaagcaagggaattaacagggaaacaaggggtgattattcctgcggtatgcgtttcccatttgagcttaaaacctgcagtattatcggcgattgaagcaggaaaatttcatatttgggcggtcgaagatgtctttgaagccttacaaattctgttacagcatccgttttatgatgaagatctacctgaaaatagtgagaaaaaatcacttttcgcgttagttcatcaagggatcgaacagaatgaaaatgaagacgcaagcggttcgattttccacaaaattcgcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtttatcaagcaaacgtaacataaaccgtcaataacggacttttctactttcttacaggaacaaaataatgaacacttgtacacctaacatcaaatcaagttatgattacaacgatcttttagcgtcaggacgaggcgaactttttggtagcgaaggtccacaactgccagcaccgtcaatgttgatgatggacagaattaccaaaatcaccgacaaagaaggtctgtttgagaaagggtatattgaagcggaattagatattaaccaagatctgcctttctttggctgtcactttatcggcgatcctgtaatgccgggttgcttaggcttagacgcaatgtggcaactggttggcttttacttaggctgggtcggcggtaaaggcaagggcagagccttaggggttggcgaagtgaaatttacagggcaaattctaccgactgccaaaaaagtgatttatcgtatcaatatgaaacgtgtgatcaaccgtaagctcgtgatggggcttgctgatggcgaagtcgaagttgatggcagaattatctatactgccacagacttaaaagtaggtctattccaagatacaacatctttctaatttttcgatctatgtcgaaaaaataaaaattgccgatttacaaaatcctttcaacatctaatatctctctcactttgggagagatattatgtttcgtgcgatcactattattgaaactttatttgcgatgagcataatggcaatcgcactctatttcttttcccccaccttattttatttacaagatcatatcgttttaaataatgaaatcgatcagataaagtcttttatttatcaaattcaagctaaagcacgttatcaaaaacataattattctatttctatcagccagaatttagcagataaaaaatggtgtatggtcgcaattgaaaaagtcagtgataaacagatcgcttgtaactgtttaaatatcgcaagttgtgatattcaaaaaagctattatctctatcaaacagaaaacgccgtagtcaaaaataatagtttatatcctaaagtttttattaatgttgatggaaagtctgggcgattagagtcgaagtgcttaagggttacggtaaataaaatctatgaaatattacaagtggaacaaaatggagtgattaatgttattcaaaaaggcaaacgcaccagttgttaatcacgcatttagtttggttgaaatattattatcattatttctaggttgcattattttatggagtttatcttctttttatagtgatagctatcgaaatcaaatcaaacaacgggaattattgaatttacaaaagcatactcaccaattacttgagtattttcaacaacatattcaacattttaattatcaaggacaaaatagaaaagaaaccaattatagtttatttgtaaacgataataagcgttattcactgaacaatccaaattgtctaatgtttttctatgatttaagtagtgatggctgtgtaggtaatcgaaataaaaaacaatcttgcgaaataaatggtgtaaataataccaaagaggtaagccgagaattttttggttttaaatttgagaaaaaagcgatttttatttatgaagatagtcaaattcagttctgtcaccaagcagattgtgaaaaaatcctaacaaattgtcaaaaaggcaactggcgaaaaatgtcagatatgtctgattataatgtcgaaaatttatcttttgagtggcttgagcagaatagattattgaaaatagaactggctctctcgtctagcaaagataaccaactaagatataaagctaccgcttatagttacctattaaatggaagtgataaatgaaacgttattatccagccagtattttattaattaccttgatattattaagcggtctgtttgcagtaatttttctcaataaagatagcttattaaaacaagaaaaagtgagcctattctattatcaacaatatctcaccgataaatatcaacttattgaaaagttagcaatagatcctgaaatagaatgccaaaatcagaaacagactaatgttatttttgagtttaaggtaatgaaatacagttttcattgtcaattttcatctatttttgatccttttaaaccaaccaaagaaaaatatattcaagtggataaaattgaaaactggttgaatttattaccttatcaatcggaaatatataaaatcaatcatttagcggagttgccagaaagtagtctagagaatccaaaaattgtgattgcattacaagatattaatgaaaagttagaaaaagatttttacggtattgtcattaccgattatttatttgatcttacaggaagaaaaagaatgtatggtacactttattccacctatgataatttacgagaagaaagaaatctcagttataaaaaagaagttattcaacatctggaaaataaattttcatcttggcactatttgccttattcacggaatatattagcaaatgaataagctcattaaagcagaaagcctgacatcattaatggtcgttatgttgattttttcagtgatatatttagcttatagccgttggcaacatacgcaaaataagcaaagcgcgcttatttttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttcagcaacagcaagccctacaaattgccgaaaatcagattgcgttactaatggcagggaagccctgtgaaaacgaaatccgccaaaatgaacagatatttaaggtagaatgtcgcagtaatacacttaaagtcagctttgcaagcggtgagattgtgatcaccaaatattaagaaattaatggttttttgtattgaaagcagttgtatatatgagtttaagaattggtaaaatgtggttgtaaactataactttagaaatgaacataaaaataattgtgagcttcatcacatttctaaaatgttacattgcaatggattgaagtcagggattgcgagtgatagcattttgccatttcttagcaatggaattgatgttatgccgttaccaaattatcaccaagatcccactttatttcacattaacaccacaccccatcacgcctattttattccctttgcgacacaagataagctcgccccccttgagcgtgaacaatctagcctatttaccctactcaatggtgaatggcaatttaactattttacgagcgtgatggatttgcctgaagattttctttctcagccttttgagcatcgcattcctgtgccatcaaactggcagacacaaggcttcgatcagcatcaatatacaaatatcaactacctattccctttcgaaccgccttatgtgccacacgataacccttgcggtgtatatcaacggacattccactacgagcctaaatcgacaaaacgctatttactgaattttgaaggggtggacgcttgcctttatctctatctcaatcaacaatttgttggctatgggcaggtcagtcattgcacaaacgaatttgatgtcaccgactttttaatctctggggaaaatcagctcaatgtcgtggtgcttaaatggtgtgatggtagctatttggaagatcaggacaaattccgtatgtcaaggattttccgagatgtttatctgctggaacgagaaccaaattatctacaagatttctttatcaaaaccagcctgtctgaagcattagatcaagcggatttatcggtcgaatgtacctttctgcaatcgccacaacagctcactttccaactgtttgatccacaacatcgcctaatcgccgaacagacaagcgatcactttaaggtaaaaattgacaaaccacagctctggaatgccgaacagccacaactttacaccttacaccttgcctatggaaacgaagtgattgaacaagcggtcggttttcgtcggatcgaagtcaaagacggtgtactcttgctcaacaaccacccgatcaaattccgcggagtaaaccgccacgacagcgatcccctaacgggttatgttatcagccgtgagcaagcagaacaggattttaggcttgatgaaacaacataacatcaacgctattcgtaccgcccactacccgaatgccccttggtttagcgaattatgcgactgctacggcttctacctgattagcgaaagtgacatagaaagccacggtgccagtatgcaatacgttccaacgccagaacacagcattttactgaatgtagcaaaacaagatgataaccaacgtattcagcaacaaacgatagataatttctgctattttgcccgacacccagactacaaacaagcaatcttagaccgtacctacgctaatgtagaacgagataaaaatcgcccatcggtactgatctggtcgctgggtaatgaagcaggttacggggaaaattttgaagccagtgcaaaatggatcaaacagcgagatccaagccgtctggttcattatgaaagtaccatttatcaacattctgaacatcgcaatgatcttaccccgttagattttcatagcgaaatgtatgccagcacagaagatatggatcgctattttgaacagccacaaaccaaaccattcctactctgcgaatactcgcacgcaatggggaactctaacggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctaacggtgatttagaagattatttccaaacctttgaaaaatatgcaggggcttgcggtggttttatctgggaatggtgcgaccacgccccatatcttcctgatggatcaggacatttcggctatggcgagagtgaaagttacatcgacaaacaccacgcaagccgactaggtctataccaaaccactgccgagcaaaatcatcaagactacgtcaaaccacaggaaaacggcagtcactacggttgtgaatatcttcacacccaagatctcgagattaccgcaccacagccgttcagcttcaatttttccccttatacacaggaagaattgaccctgaaaaaacatcattacgagctagaaaaatcgccgtatcacattctgtgtgtcgattataaaatgagtggtattggttcgaactcttgtgggccgaatttgaaagaggggtatcggataaatgataaagagataagctggataattcagctatatatgaatacctaatataaaatgacaatgagtaaagttgtgtctatccctatctggtacaataaaggatagacataactttaagtgctatttaatagactctagttttttaattaaaatctcttctggcatagcctgaattttccgcataaagtagaaaaatagccctgcggctaaacttaagcagacacagaatgtcagccaaaatcctgttgccgccatcggctgaacgatccaatcggtgcgagccaaaatagtgcctagtggcattccgattaaccagtagcaaattaaggttgtcagcaaaataggtttggtatttttataaccacgcaaaatgccattgcataccgcttggatagagtcggggatttgatagatcgctgcaaaaatcaataaactagatgcgattgcaatagaagtcggatcgctggtaaaggcataggggatcagatctttgagcagtaaaatcaccattgccagtcccattgcgaccattgcacccgtaaaaatggcgtgataagtcagatattttgtttctgcaacacgcttttctcccaacgtttgcccaactaaaatggttgtggcaatgctaaatgagagtgggatcataaaaaagagcgagctggtttgtaaggcaacctgatggcttgccaccacttgtgagccaagcggtgagataatcaaggaagatgccgcaaacagcatcacttcggtaaacagtgcaaaccctatcggtgtaccaagtttgaacagtttgcttaaggttgctttacagggtttttcgatccatttttcaaatagacgaatatccttttgtgctgggttggtataacaatagtgtaaaatcagcccaaacattacccagtttacgattgccgttgccacaccacaaccgaccgcccctaattcaggcatacccagtttgccgaaaataaaaatatagttgagtggaatatttaaaattaagcccaaaaaggtgatgtacatcgctggtttagggttggatagtccgtcgttaaaacagcgtaagttcaccgcaagcaaggctggaataatcccgacacttaaagcggtaagataatcttgtgcttttcctgaaaagacttttggggtatccatcagatctaaaatcaaatgggcattgagatagataaaaattaacggcaggctgagcatcaacacaatccaaacgccttgacggatttgatgtgcaatcaaggaacgttggctcgaaccgtttagataagaaaccgttggagtaatcgcatttaatatccccaacacaaataaaaacaagggaaagtagatcgaattactgaccgctatcgccgacacatcatcatcgctgactaacccagccataataatatccgccagtcccattcccgaagcagctaattgagagatgaaaatcgggatcgaaagtttgaataatttttgcgtattttcaggatatttctgccattgaaagttcattctatctaccttttaaaattcaggtttcgcttcaaatgtcatcagttcttgcgtaactgggtgcgtaatggttaatgcttctgcgtgtaaacagagccttggcgatagactttttgccaacggatttgcataaaatttatcccctacaattggatgacctaaggctaaacagtgtacgcgtaattggtgtgaacgcccagtataaggggttaatgtcacccttgtggtgttattgggataatgtgcaagaatttcatagaaagtaaccgcttgtttgccccgttcgtagcaaattttttggcgtggacgattttcccagtcgcaaattaacggaaaattcattgtccccgtatcgccaactttttcgcctaatttgccccaaactaacgcttgatagtgctttttcggctcacgttcacgaaattgacgtttgagttctttttccgcctgtttgcttaatgcaaacaacaaaataccgcttgtcgccatatctaaacggtgagcaggctcagtaaaaccatatttctgttgtacacgcaccatcgcactgtcttgatattcagggcgatttccaggaacagaaagtaagccacttggtttattaatcactaaaatatgattatcacaataaacttcgtcaagccaaggttcaacagggggattgtattcgattaatgccatagaaattattcactgatttgtagcaaagtcgcaattttagcttttacttcgcttaactgatgatggttaattttacctttaaatttagcgtgacgaatacgccagtcaaggcttttaatttgatcggaaagcacaacattttggggggtacctgcaatattgacttcgaaaggatagccttttacttttgttgtgagcgggcagcaaattaacaaccctgtttgacgattataaatcgtgggcgttaacactaatgctggacgatggccagcttgttcatgtcctgcttgcggatcaaaatcaagccaaataatatcaccaacgtcagggatatactcttgagtagtcatagcatttccttgccaacaggcttgccaaaatcgacttcattgtgcaaattatcttcagtaatacctgaaagaagttgctctaaattatatttaggtttaatcggctcaataattaggcgaccatcaacttcttgaatatcgactaaactctctgcctgtaatttcaatgaattagataataaagcaggaatgcgaatgcctacgctatttccccattttttgacagccacttgcatataggttcctttaaaattatacaaagtataactctgcggattatagagaaactgtcgccatttgccaactttttctataatttctatctgttgcagaaatctcttgttttttataaaaaatagcgtatcttttgcacgttcattttgaacattacaatttatttacatttcttttggagaacaccatgaaaccgctttttgcaagttttgcaactgctttcaccgctctcagcgtgctgtttagctcagttgctatcgcatcaccttccgataaaacctttaaaatcagtgctattcctgactataacgctgccgaaatgacccgttcattcgacagttttgctgagtatttaggcaaagaaacagggttaaaggtgcaatatgtgcctgtcaccgattatgctgccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgtagtcaccgcattccgtcgtggcgaaattgatttagtctggttcggtggtttaacgggggtacaagctcgtgccaaagtacaaggtgctgaagctatcgcacaacgtccgcaagatgaaaaatttaagtccgtctttatcaagcaaaaaggcttagataacgtgaaagagattaaagatgttaaaggtcacacccttgcttttggtagcgaaagttcgacatcaggtcatttaatgcctcgctttttcttaacggaagctggaattaacccagaaaaagacttagacgctcaaccgacttacagcggttcgcacgataaaacctacggcttagtagaagcagattcagtacaaatcggtgcagtgaataagcagtactgggataaaatggtgaaagaaggcaaggttaatcacgataaagtcgagcttttctacaccacaccagattactatgattacaactggaccattaatcttgttgataaaaaatttggtgacggtaccaaagagaaagtcaaagcggcattattaaaagccgatgcgtcaagctcgcaggtgatgaatttactctctgccgagaagtttatcccaacgcaaaacagcaactatcaagatattgagaaannnnnnnnnnnnnnnnnnnngtggttaaaaaagatcagcagttatggtgtgaaagcggtgagatcgtcagcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccaccacaccaccaaacatttcggcaagcaagccgttttagacgacatctgtttaaccattcgctcaggtgaaatcgtggcgttagtcgggccgagtggatcggggaaatcgacattaatgaatagcattatgcgttccgtgcctttaacaagcggtgagatttggctggaaaattgcaatattcaagattacccagataacaaacagtttgctcaacaagtcggtatgcttcatcaacagtatgatttagtcaaacaactggaagttatccacaatgtcttggctggcaggctgaaccagtggggattttggcaatccttattctctttggttaaaccgcaagaaagacatcttgccgagcaagcacttgctgccgttgggctattggataaaatcgatcagccaactgccgagctgtcaggtggtgagcagcagcgtgttgcaatagctcgtctgttagttcaaaaccctaaattgattttagccgatgaaccagtgtccgcactcgatcctgttaatgcacaaaatgtcttggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcggcattaaacagggaaaaattgtgtttgatttgcaaacagaacaagtcactcaagagcaacttaatgtcttatacggattggtaaaaaatgaaacataaccgaccgcttggactaaatgaacggcgaaatttgctgacgggcatgttgttgcttgcatttttgttgagcctatttgctgtggataacgacaaagggttgatgcattctggtggttgggcaacgcttaatcgactattttccagcttattgtcccctgacttttctactgatttactgaaactcgccttgcaatccacttggctcacttttgcttatgccttgattacactctctttgtctatgcttggcggattttgcttaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgcatccggtgtgctgtttcgttcactcattttgcagggggcagctcgagcgatattgggttttctacgtgctattcacgaattgatttgggcatggttctttgttgcggctgtcgggttaaatccgataggtgcagtgtttgcccttgctattccttattctggctacttaggcaaaatctatgcagatacgttacaagcggtgccttctaagccgatttttgcactaaaagaagcaggggcaacgccgttacaatgtctgatttatggctatttgccccaagccttgccgacgatgttgagctataccatgtatcgccttgaatgtgcgatccgctcttcatcggtactttcttttgttgggttaggagggatcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgggttaggagggatcggtatgcaaattcagctttccctacaagatctgaaatacgatcaggtttggacattcttgatctttcttgttgggttaatcgttttggttgaccgctggagctatgctgtcaggagccgagtaaaatgagaaaacatatcgaccgctattttatccgctattctttttggatagtattaggacttatcgggctgtcgtggggctatattcttaaagatcaacccactgcacttagtgaactgtttcgagcggaaaattgggattatcttacggaatttttagttggaatggctggtgtgggtgaagagctacctgcctatcttgaccctgaaatgtggcaaaaagccctatggctctcgtaaacctttgtgatgagtattctggcaacaggcattgcaggcatggcgatgttccttttggttctgccgtccgctcgcaacgtggcacagggacactttcgccacagaacatactggtatcatcgtgtcgcttattatatcagtcgggggctatttctgtttagtcgatccgtaccggaattgatgtgggcgatgattttagtctttatcttcaaaccagggatcattccaggtgcattagcattagccattcacaatttcggtgtattaggcaaactgtgcggcgaagtggttgaagatatggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaccgatacgccatttaatgcaaaatggggcttcacaaaaccaaattttgttttacgggatctatcctgctgtgatgcgtacttttctcaattacattctttatcgtatggaaaacattattcgggcaacgctgattgtcggttttgttggggcaagtggtttaggtatgcagtttaaactggcgatgagttttttccattactctgaaattaccctttatctgctctgttatttgctgttagtctatgtgaccgatgcactgtcggcgttggcaaagaaatttattgcagaaaaaaattgaattattttgataacataatgtctactcttaactattttttattaaccaaaaggaaagcaatatgaattttaatagcattttaaacggcgttttaaaatctgtcggcaacaccgctaatcaaagtaaatcggacttaggtaacgtattaagctctgtattgggttctgccaaaaatactgccggtgagatcaaatctggcaacgtagatactattaccaaagttggtggcggtgcggcattagtcggtattctatcaatggtgttgggcagaaacggcggagctaatttgactaagctcggctctttagccgcacttggtggattggcttacaaagcctatcaagattatcaaaagaaccaggcaacaagccaaacgacagaactaagccaaacagcttttgaagcggatagttcggaagagaagggagcaattattttacgtacaatgcttgcagctgcattagcagacggtgagctggatgagaacgaaaaagctttaatcttaaaagagggcggtaatgaccctgaattacaacaatggttactgcatgaaatgcacgagccagtatccgtgaatgaaattgcaaaaactgtcggaaacgacaccgctttagcggcacaagtttaccttgctgcacgcttggtctgtcaagagctctctagaaaagagatcgtatttttatcccacttagccgagaagctaaatttaaacgaaaattttgtagaacaattagaaaaacgggctggattctaacattaaacatgattttcccacaaattcactattttgatagttgttaatgtttatattatgtttaataaatgagcacttgtttttttcgataagaagaatgaaataacatattgttttttaaaggaaaaaagcaaaatatctgggctgattttaggttatacacgatcattatcccgatctatcacaattttatccacagggaatggggataaaagcacatcaaatgtgaatagaatggcaatttagtctgaaaagtggttaagttatcctagaaagaaaataaaatgagcgattaaatgtgtgcttatacagtgaaaagggatcgaaaatgatcgatggcaggaagtaagatctgaattaagatcaagcggttagataacttatcccaaaaaagttatcaacaaattttcaagttatccacagagttatccacggttgcgaaaaaatttggctatctcaccgcttgtttttgccttgctagttgttcaaatagccgaaatatgaaacaatcacaccattttcaaattgattaaataaggcggtctaaattgatcgatttcgatggttaccgcccgaatgttggtatcgttatctgtaataagcaagggcaagttctgtgggcgaagcggtttggtcaaaactcttggcaatttcctcaagggggaattaatgagggggaaaacattgaacaagcaatgtaccgtgagctttatgaagaagtcggcttagcgaaaaaagatgtgcgattgctttgggcatcgaagtattggctgagatataaattaccaaaacggttagttcgtaatgagcaaactcaacctgtatgtattggtcaaaaacagcgttggtttctgttgcagttagtggcagacgagggggtaattaatcttaaaaccagtaaaacgccagagtttgatggctggcggtgggtgagcttttggtatcctgtgcgacaggtggtgtcgtttaaacgtgatgtgtaccgcaaggtgatgaaagagtttgctcaggtgttgatgggtgagcagaaaaaagtcgaaagcgagaaaaatcgagataacaaagagtttacccacgagagaaaagagtttcgtactcagccaaaacgtgagcttcgtaaaccatatcgggtgtttaaggggaaaaaatgatggtggaaatgtttgtctgttgcttgattttaggctcagttgctggttttttagcagggttgtttggtatcggtggcggtatgattattgttccaacccttgtgtatttgttgcctcaaattggtgtgccagatgatttgttgatgtcgattgcattgggtacgtcgttttcaacgattgtgctaaccactttttcagcggcacaacgtcatcataagttaggcaatgtacaatggtcagttgtgaagttttttgtgcctgcgttgatggtggcggtgtttatttcaggcttgattgtgagtgatctgccaaaaagtgtaatgacaaaaatctttgcggtgatgatcctgtatctttcgctgaagatgtttttatcgctcaagccaaagcaagcagagcctaagcctctgactactcaatctacgttgattgctggaggggtaatcggggtgttatccagttttgctggcattgcaggcggtgcttttattgtgccatttttaaatagcagagggattgagctgaaaaaagcgattggcacttcttctttttgtggtggtttattaggattagctggagcgattagctttgtgattagtggttgggataatccgaatttgccacaatatgcggtaggttatgtgtatttacctgcgttgttgggaattacgctgacatctatttttacctcaaaattaggggcaacggcagcgaacaaattgcctgtgccgattttaaaacgtgcttttgccgttttcttgatgtgtgttgccgtgaatatgtttttaaaataaaggaaatttatgtctgaacagtttttaacttttcctaatatcgatcccgttgcgttgcagttaggtccggtttctttacactggtacggcattatgtacctgcttggttttggctttgcctattggcttggtaccaaacgtgcgaaaaattctaatggggtatggagtgtcgaacaggtcgatcaactgctgtttaatggcttctggggcgttgttctagggggaagaattggtgatgtgttcttttatagctttgaccgtttcctacaagatcctctctatttatttcgtatttgggaagggggaatgtcgttccacggtggtttacttggtgtgattgtcgcaatgctttggacctctcgccgtcaaaatcgcaacttttggcaaaccgctgactttatcgcaccgcttattccttttggtttaggattaggacgtattggtaactttattaatgatgaactttggggacgtgtgacagatgtgccttgggcgataatgtttccaagtggcggttatttgcctcgtcacccctctcaactttacgaagcggttttagaaggcttagtgctgttctttatcctcaatggctatatccgtaagcctcgaccgggctcggggtgttccgttttatcgttgaatacttccgagagttcgatccaaatgtaaatacggcagcggatttaatcacacgagggcagttgctttcattgccaatgattatcgggggattggtgattatggttgtggcttattaccgacataggttaagtaatgactaactaaaattagtttacattttttatttagttatatggcagcagaataatagctaattatgttttaggtaatctcaatttataatgaatattttgatagggcgtttccaataattctatattgtgctatagttcgcactttgataattagcttctcattcgcatctgagtaagaagcactcagcccaaaaattgtagtaatggcaaagcaagattcggattgtattacgcttgatctgtttgaaaatatgccaaaggttgggcgacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttgggcgacctcgcacaaatcctctaagcggagagcaacaagttagaattaataaacgtaatcaactcaggcgagatcgttcgtcaggattaagacggattgagcttaaattgcattcggatttggtagcggcattggaacaagaagctgcggtaaaagggctgtctagagggcagttaattgaactcattttaaacgattatctcaatggagattccattgaattaagtaaataggtatttcaaatggcagttgtcggtttattttacggtagtgatactggaaacacagaaaacatttctaaaatgattcaaaaacaactaggtgaaaatctagtggatattcgtgatattgcaaaaagcacgaaggaagatattgaagcctacgatttcttattaattggtattccaacgtggtattacggtgaatctcaagcagattgggacgattttatgccgacattaaaagaaattgattttacaggaaaaatcgtgggtatctttggttgtggcgaccaagaagactatgcagaatatttctgtgatgcaatgggaactgtgcgtgatgttattgaacctaatggcggtacaattgtcggtcactggcctacggaaggttatactttcgaggcttcacaagcattaattgatgatgaaacctttgttggtttatgtattgatgaagatcgccagccagaactcaccgaagaacgtgtaaaccgttggtgtaaacaaatttttgatgaaatgtatttagcggaattagcttaatatatctattggaggatatatgtctgaagaaaatgtgaaattgttgaaaaaagtaggtttaaaagttactgggccacgtttaacaatccttgagttaatgcaaatcacccgtgatagtatgcagcatttttctgctgaggacatttataaattattgctagaacgtcagtctgaaattggattagcaacagtttatcgtgtattaaatcaatttgaagaagttggcattttaactcgccataattttgatgcgaataaagccgtctatgaattaaatatgaaccaccagcacgaccatattatctgtatggattgtggtaaagtgtttgaatttaaagactctgaaattgaacgccgtcagcgtgaaatcagccaacaacacggaattgagcttgcaaaccatagcttatatttgtatggtaaatgtagcaatattcaaaaatgtgatgagaaagacaaaaaataattcttctttttcaatgagttaataaacacaagagcggtgagatttcgcaaaccttttgcaaaatctcgccgcttgcttgtatttaaaagtgataaaatgatgtctgaaaatatgccaaacagtattcctgctaaaattagacagcctcgtaaaatttcgccattttggttattgccaattgtcgcttttgtgattggttgtttgctttttttccaaattcttcaagagcaaggacagaaaattaccattcgttttagtaaaggcgatgggattactgcaggaaaaaccgctattcgttatcaaggcttgcaaattggtcaagtaaaaaaagtctattttatcaatgagttaaaagaggttgaggtggaggcggaagttaatcccgaagcgaaatcggtattaaaagaaggaacaaagttctggctagtcaaaccgagtgcctctttagctggggtgtcggggttagatgcacttgtttcaggtaactacatcactttattgccgaatgatgatgaagatgcctctagtgaagatgaatttgtggctgaagatgaaccgcctgcggtaactgttgctgatggcgatttattggtgaaattagttgcctcagatttgggctcaatgactgtgggggcaagcgtgtattatcgaaaagtgccagtgggaagcattgccgattaccgctttactccagatcaaaagaatgtcgaaattgacgtagttattgataaaaaatacgccaatctcgtcaaaaaagaaagtcgcttttggaacattagcggtattcaatttaatgccaatcttactggcgtaaatctcaatgtagatagccttgcttcaatggtgcaaggggctgttgcttttgactcgcctgagatggcaacaaatgccaaacagggcgaacgttttcaacttttcgataacttaaaattggctcaacgaggaacggaagtcaatatcaccttgccaataatgccgaatttaaaagtaaatgaaacgccggtatatttccaaaacctgcaagttggcgtactttcgcatctcgaactgaatgaaaccgaacaagattactttgaaaccaaaccaaccaaagcgactattcaaggtaaattattgatcgaccctgcacatacggatttattacgctcaggcagtcaaattctcctgaaagaacctaaatttgcactcaataaagaacaattgagtaaagtgggtgagctattgagaggggcttactttgaaattgaaaagggtgatggcgagcctaaactgacgtttaatgtacaaaaagaagctgattatttgctcactcgtcctaacgttttagcaattaccctttcatcgccgcaatcttatggtgtaagcgaagggcagggcatttattataacgatatacaaattggcgaaattgtgaaacgccagttatcgcttaacggcgtagaatttcaaggcatcatctatccgccttatcgtacccttgtcgcagggaacagcaaatttgtggcgatttcacacttagatattgctgttggcttagatggtctaagagtacaatctgcttctccatctgaatggcttgctggcggtattcgtattctctcagataaagctcaaggggaagcgaaaaaacaatatccgttatacaaagatcttgagagtgctgaagctggtattgtaagcggtgagaaaaaggcaacgctgagtttgtctgctacagaattatccggcattgataaaggctcacaagtgctttatcgcaacttcccgataggtgaagtacttaatattcgcccacaaaaaacgaagtttgaagttgatctatttattgaacctaaatatcgccatctgctgacggaaactagtcgattttgggttgagcctgcggtagatgtaaacgtgtctaccaacggtgttaatctcaaaatgggttcactcatgcgaacactcaaaggggcgattagctttgataatcaaggaactaaaggtaacaaaaccttatacagcagttatacgaaagcgacttctggtaatacttatatcaccttgattgctcaagatgcttctaaattaagcaaaggaatgccgattaagtatatgggattaaccatcggcaatgttgaaacgctacagctagacaatgcaaaaaaacaggttaaagccaccgcttacatcgaaggacaatattatgccatcgttgccaaagcaggtagcaaatttaatgccgtttcccctgaaattgacacaacaggcttcaaaaatcttgatgccgttattcaaaactacatcagcgtagaagccggaaatggcaaacgaaaaacacagttcaaattaggggcaacggacaccgcagatacacaatacggcaacggcttcccaatcattgtggaaaccacagacgcaaatggcatcacccctcaagcccctgtaatgtatcgaggaatgcaagtgggtatggtacaacagctcagtttaagcgaactcggcgaccgagtgctgatccatttacgcatagccaaccaatataaacaccttgtccgtaaaaatagcgagttctgggcttcgtcaggctatacaatggatattagcctcaatggtgtcagtatcaactcaggcacaatgtctcaattatttaacggcggaattagtttctcaaccccatcaagtaaggttgttcaacctcaggcagaagctaaccgcagatttttattacaacgtaaattacctgaagaagcattagagtgggatcaggggttggcagagtaggaaattcatgtaacagacaaaacattctgaattaaatatagaaaagatggcaaatcgtttagagggatcatttagtgaacttaagcgaaaattaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaatggttgaaaatttcaacgggcagcattacaacatttatcactgtataaggcaaatattattttaaaaaataaaatttttactaaagaataaggaacttattggaaagtctatggactactgtaactaaataaaatatagtaggtagcatttttattcgcttacctaacattcattttttagattggaacattttatgtctgaacaacaacttaataccattcaaaacctaaaaaccgctttatctacaaaagaaatcattgcttatttggctgaaaaatttccgctttgctttagtttagaaggcgaagctaaacctctaaaaattggacttttccaagatttagttgaagcgctgagtaatgatgaaaaaatcagtaaaacggggcttcgtcaagcattacgcgtttatacaatgagctggcgttacttacacgcatgtaaagaaggtgctgtacgtgtcggtcttcaaggagaagaagcgggtgttgttgaagctgcacaagcagaacatgcagcgcaatctttagccgaagcaaaagtagcttatgcagaacgtaaagctctacaattaaaagagaaacgcaaggaagagcgtaaaactttctttaaacaaaaagcacgtgaagcacatgccaaaaaacgggctgaaacgaaaaaacaagaaatgccaaaagcatctttagaaagtttgtccgcattagaaagcaaatttgccaaaggcaagaaatagtcgcatttataggattgatatgaaatataataaattcaccacattacttgggttatgtttgggagtttgtagcataaatagttttgctgcagaacctcaaataaaagaaagtgaattaatcattccaaaaccaacagaacaacatagtatttcaactaaacgtgttacagctcgtttaacacaatcgcattatcataagtttcaactagatgatgctttttctgagaaaatctttaatcgttatattgattggcttgatggttctcacaatacctttttacagtctgatattgatgaattgcgtgctaagtatgcaaccgagttagatgaagaactctatgaaggcaaactagatattgcctttgaaatgtatgagttaatgacaaaacgtcgttatgaacgttataaatatgctttgtctttgttagataaagagcctgatttaaaagggcaggatcaaattgaaaatgatcgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgatgagctttggttgcaacgagtaaaaaacgatattattaatctttatttgaaagataagaaatggcctgaaatcaagaaaacactgactaaacgttataacttggcaattcgtcgtttaacacaaaataaagccgatgatattctgcaaacttatctcaacgcttttgcaagagaaattgatccgcatacaagttatctttcacctcgtgcagctaaacgtttccaagagagtatgaacttgtctttagaaggcattggtgcgacgctttcaatggaagatgatattacgatcattaaatctttagtgcctggtgcgccagcagcgcgtagtaaaaaaattgcagcaggtgacaaaattgttggtgtggggcaatcaaaagataaaatcgaagatgtgattggctggcgtttagatgatgttgtcgataatatcaaaggtaaaaaaggttcgacggtttatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaggcggcaaaaccaagattattagtttagttcgggataaaattcgtcttgaagacagtgcggcgaaattaactgttgataaagtagacggaaaaaatattgctgtgatcaaaattccaagtttctatattggtttgactgcagatgtgcgtaaacttctcgaacagatgaaaaccaaaaaagcagatgggttgattattgacctgcgtgaaaatggtggcggttctttgcctgaggtagtggaattaacgggattatttattaaagatggtcctgttgttcaggttagagatgcttttaatcgtattcgtgttcacgaagataccgatagtacaacattatatgatggcaacattttagtgatgattaaccgtcatagtgcttcggcttctgaaatttttgcggctgcaatgcaagattacaatcgtgcgattattatcgggcagcaaagttttggtaaaggtactgttcaacaaaaccgttctttaaatatggtttatgatttggatcaagagccgttaggttttatccaatatacaatccaaaaattctatcgaattaatggtggaagcacccaaattaaaggggttgaagcagatattcgtttccctgaaattatcaatgcagaaaaaacaggggaaggatttgaagataatgctttgccttgggataaaattcctgcagcaacttattcagaagtcgcaaaagctagagatgtagttgcacaactcactgaaaatcacgaaaaacgtattgctaaaaatcctgaatttattgctttaaatgaaactatcgcaattaataaggaaagagatgatcgtaaatttacctcacttaatttggcttctcgtcaagaagagagtaaatctgatgaagctcgtcgtttgaaagatttaaatgcccgctttaaacgtgaaggtaaaaaacagatcaaagatcttgaacagttaccaaaagactatgaagctcctgatttcttcttaaaagaaacggagcagatgatggttgattggttacaatttgataaaaaataataaatacgtttataatgtggaagtttatcaggccgctgtttaagcggtctgatttattactcattttcctaatggattaaattgaatgaaaagtttaacttttttgtcagtaatattgttttctagtgctgtggttgctgaaaatggaagtgcgttgaatgttagttctcaacataatgctgcaacgcctgttcctgatgaacaaattttgcctcagttaagttttaaagcgcaattagtccgtattgctgaactgacacaagatgcagaatatcaatttcaattggctgaaagaaaacgcattgaagccgaaaaattaattcatgccgaacaacgtattcaacaagaaacattaggctatcatttattattatccaatacgacagcaaaagtctatctcaataatgagtttgcccctttgtggaaagataaagtggcagaaaaacagtttttaaaagaatatgcagtattcgctgtaagcggcgtttcgcctaaatcggctaatgcgttacaacaaattctaaatatgaatgagggatttgctcgcgatattctactcacagatagtttcttagactatctctattacacagaaaatgtcgatcaatttgcaaatcaatggttatatcatttaggaagttattcaattaaaacaccaacagaatatcgtattgctacttggttggaagcgattaagcaagatcgctacgctcagtttgtcacggatctaatacctaaaaaccatatttaccaagaaaccgtacaaaaattatttgaaatatcatctaatgatgctctcaatcagggtggtaataaatcagcaaaatctacaaaagagaataaaggtagtgtaaacacgccttcatttactcaattagcacttaatgcacagcgtttacgtcttattccaagttttaataatggaatttttgtcaatatcccaagctatcagctctattatttcagagagggcaaacttgttttacagtctaaagtaatcgtgggaagaaatgatcgcaaaacacctgtcatgtacagcaaactgagcaacgttgtcgtcaatccgccttggaatgttccatcaacaattaagaataaagatttagtaccaaaacttcgtaaagatccaatccttgctgataaattaggctatgaaattttagatgggaaagggaataaattcagtgctcatagtatcaactgggcagcttatgaaggaaaaaataatttcccgtatcatatccgtcaaaaagcgggagatgatagtgctttagggcgttataaatttaatatgccaagttccgatgcaatctatttgcacgatacaccaaatagagggttatttagtaaaaaaatcgtgcgttaagctctggctgtgttcgtgtagctaaagcagatgaactagctacgttattattagcagaagctgggtggtcagcgcagagaaaacaggacgttcttgcaagcaaaaaaacaacttctgcacctattcgttcagataatcctgtttatttatattatgtaacatcctggattgaaggcggtaaaatatacaccttacctgatatttatcaatttgataaatcattacctaaaatcaacttagattgggaaaaagtaaaaagtgtgatctagtccacaaaataaaaaatttccgaaaacgataggctattttttagaacttcctttttgataaaatgtcgaagtcaggctgaatatatttaccttcaagagattaaaggagagattgtcggtaaataacccaaatgcgaggataaaatggaacaaacaaatttacaacgccaaagatggcttgcattaggcggaatagttttgggtgcaaccttgttacctaatttagttcatgcggtaacgtcaactccaaaacctcttattctacgtttaaaacgcttaagtacaggcgagaccttatctgctaattatcacactaacggatttgctgcaaaggatcttaacaaattaaatcatattatgcgcgatgtgcatatcaacagaattaagcgaattgacccaaaactattcgtaaaattaactcaaattcaagctcgcttgggtcttcgtaaatctgaaattcttattgtaagcggatatcgttctgctcaaacaaatgctagattacgccgtcgtagtcgaggcgttgctagcaatagctaccatattttaggtaaagccattgatttccgtattgaaggtgttcctcttgcccgcataaaagcggcagcagaaagcctgaataacgggggggttggttattatcctcacagtaattttgtccacgtcgacactggccctgttcgtacttggcgtggttcataagcggtttgattttatgtttaatttgcaaattatccctgtaagtgttttccaacaaaattgttctgtcgtttgggataacgaaaagaatgcggttattattgacgctggtgatgatgcagacaaaataattcggtttgtggaagaacagcaattaaatgtgcagaaattgttgattactcacggtcatcttgatcatattatggctgtcgatcaactgagaaaacattttaatgttgatgtctttggttctcatcaaaacgatcaacctctttttgaacaacttcctaatatttgtcagagctacgggcttcctgcatcgcccgcttttctaccagatcactggttaaatgcaggtgataaaattcaaattggggctttaacattccatattcgctatttaccaggccattcaccaggtcatatcggcttttttgattttgagaataaaattgcctttagtggcgatgtgcttttcaaagatagtattggaagaaccgatttataccaaggtaattttgagcagctcatttatacaataaaaacacaactatttgatttagaagatgattttatcattattcctggacacggatctcataccacagtaggacgtgaaaaacaacacaacccttttttaaagtagtcatatgaaaaaaattaaacttctatttttagttctcaataccgcttttctaaccgcttgtactgcttctattgatcctgaaactggcacccgttcagatccgttggaaggatttaaccgtgccatgtggaaagtcaattacgaatatctagacccttatattcttgaacctgtggcaaaaggttggcgagattatgtacctagcccaattaaaacaggtttagtcaatgtggcaaataaccttgatgaacctgccagctttgtaaaccgattaattgaaggggaaggacaaaaagcgatggttcactttactcgcttttggtttaactctatctttggattaggcgggttaattgacttcgcgagtatgaccaatgatcttaaaattgataaacgtagagaatttggggatactctaggcgcgtataatgtgcctacaggaccttatgtgatgttaccaatgtatggacccgcaacgcctcgtcaagatttaggtcgattagtagatactagttatccagttttatctttactcgctacaccttggagtatcacaaaatatgtcgtacaaggagtagattcccgtgcacagcttataggacaagaagcgttattgaagcaatctcaagatccttacattactttccgagaagcttattttcaaaatttagagtttaaagtaaaagatggtaaaacagaaaatagtgagcaagaaacattatctgaagaacagctaaaaaatattgattgatgatttacctgtaaaaatttacactaaaacgcaaaattcctattgacactgtgtgtttaaacagtaaaataactgtataaacaaacagatttattttagaggattttatggcgtatcttagatcactaacattggcacaatcccatcagcctttacccctttatcgagattctaatataaagcacccaatcaaactggatctctattctctttatgttcgtcgtccttctgaaacctttctggttcatgtgaaaaaccctaatttaattgcatgggggatcgaattagatgatttgttaattgtagagaataatcaatctgctgaagttaacgatcttttggtattagagaaaaatcaagagtataagttctaccaatttttcagtgagattaatggagagaagattttattttctttagacacctcagaacctaatttacgcattaaagaatggagtgatgtaaatatcgctggggtgattacaaatatcgtacatcaagtaaaacatcgcgcattgcaaaaaaacagattgtctaattgataggtataataaataaaatacttgctaatggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaatcttgtataaacaacatattacgcctttttgttaatcagttatgattatttaatttttgcttaagctcgctaaataatccctctaagcgatttattgtattttctatatctaattcagaatrtttytcatagrtaaaaataaaatccatataacgctttaarctggyataagtacttcttgcattacgacgtttataagggaaatggtcttttttattggctttatcacttcgttcttttaaaaacgtttggtgttttataaactaaggacgtaatcgctaataaaattcgttttttaagataaacgttttatgacattcattacaaaagtaaggttgagtattattttgtataccatgtttctttattttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttacttcaactgagcaaaggcttgtagcaagtctgctttaatatcctcaacgtgttcaagccccaccgaaaaacgcaagagcttattacacacaccacgagcgatacgttctgcttcaggaatatccatatgggtttgggttgcagggtaagtaataaaactttctgtaccgcctaaactttccgcaaaggtaatcatcttgatcgcttttaagaatggattaacccagttttcatctttcaagcggaaagataacataccgcttttaccagaataaagcacatcttgcacttgcggttgttccgctaagaatttagcgagttcggtcgcattttgttggtgacgctcaacacgcaacgcaagggtttttaagccacgaataatcatataagcgtcaaacggtgaaagcactgccccagcaccattttgcaaatagaacaagcggtcacataacgcttgcccttttgctaccactaagccagctaacacatcattatgtcctgccaaatatttggttgcactgtgaataacaatgtctgccccaagttcaatcgggcggaataatactggtgttaagaaagtattatcgacaatcagcagtaaattgtgctttttagcaattttcgcaatcgctgcgacatcacactcttccatcaatggattagacggtgtttcaacaaaaatcgctttagtatttggattaatcgctttctcaatagcatcaagaactgccgtgttcacataaacaggcttcacagtattgttatttttatagctaaaatctaacaagcggtaagttccgccataaacatcgctagagataatccactcgtcaggggcagtaaagagcgacatcaccagttgaattgccgccatacctgaggctaacgcaaaacctgcatcgccgccctctaagtccgcaatgccttgctcaagtacactacgagttgggtttttggtacgagtatagtcaaatccagtagactcgccgatccccatatgtccataggcagtcgaaaggaaaatcggggtcgccaccgcaccggtacgctcatcggtacgattacccagttggactaaagtactttcaatgttgttatatttcatatctatccttttgcaaaattttgattaaatctgaccgcttttctttattataaattgtttaaatccaacacatcggtcatatcaaaaagaccgttttgtttggtttgaagccattttgctgcacgcacagcaccgttagcaaacgtcattcggcttgaagctttatgggcaatttcaacacgttcgccttcatcggcaaaccaaacactgtgttcaccgactacatcacctgcacggatcgtcgcaaaaccgatttcatcacgtttacgttcccctgtgatcccttcacgcgcaaatacgccgtgtgtttttaaatcacgacctaaggttttggcaatatgttcgcccattgaaagcgctgtgccagatggcgcatcaactttatggcggtggtgagcttcaatcacctcaatatcgcaataatcgcccatcacttttgccgctttttctaacagtttaaatactaagttcaccccaacgctgtaattggaagcaaagacaatactgattttctctgatgcagatttaatcgcctgtttgcccgcatcatcaaaaccagttgtaccgatcaccatttttttattatgtgcgacacaaaaagcgatgtgttccaacgtcccttcagggcgagtaaaatcaatcaacagatcaaaatgattgacctgtgaagctaaatcgtccgtgacagtcacgcctaaatccccaataccagccaactcgccagcatcagccccgactaatgatgatcctttacgttcaaatactgcacctaattctacgccctctgcgttatttacggcttggaccaactgacgacccattctgccaccagcaccgacaacgccaatttttaatgtcactataaatcctctataaaatgttgtgataagcggttggattttacaagaaagttacgtttttgaatacagaaagataagcatccaaatagagaaaacccgatctgcgaagatcgggttggtctatagtgaatagcttattcaggtcttacccctaaagtatgacaaatagcataacttaattctgaacggtttaaggtataaaagtggaaatcttttactccctctttagagaggattttcaccatatccattgcaatacttgcccctacaaggttacgcgtagtttgatcatcgtctaaaccttgatacattttcgccatccagctagggatttttacattggtaatttttgccatcttttctaactgtttgaagttcgacacaggtaaaatgccaggcacgatttcaacatcaatccccaccgttgcacaacgatcacggaagcgaagatagctatcaatatcaaagaaaaactgagtaatagcacggcttgcacctgcgtcaattttctgtttcaaatagagcaaatcagattgggctgattttgcttcagggtgaacctcagggtaagcggcaacagaaatctcaaaatcggcaacctcttttaacagttttactaaatccgacgcataaaaaggtttcttcgcatagccagtaggctcatcgccacgcaaagccacaatgtgacgaatgccactgtcccaataatcttttgcaatagcacgaagttcgtcaaggggtgcatcaatacctgttaaatgtggagcagcgacaatccctgtttcttgttgaatggtttttacgatagagtgcgtgcgattacgttccccagagtttgcaccataagtcacagaaacaaacttcggtttaagcactttcaaacgatgaatagagtcccataacagcgtttccatcttttcatttttaggtggaaaaaattcaaaagacacattaattttgccgtttaagtcggcaacactttgatttaaaagatcaatctcttttgcataactcattcaacacctctatcgagcttccattgttgttatttgtataatgtttagtttgcatactgctgtcttttttagacgtttagatggctaaaactttaaaatgccagcgatatgatgtcaataaaattattttcattatttcatgaatttaatttatgtaacttgcagataatgatgaaaatttttaaatgtaaattttttgttaaatttgttatctgatggtattatcccgttgcttgtaaaaaatacaacatctgctgtttttattttcaaactcaattaagcggtatcaggtcgcatttaagggggaaataatgctatctcaactcactacaccaaaagggcaagctattcaactaaatcatgatggttcattgtctgttccaaattacccaattattccttttattgagggagatggaattggcgttgatgtcacaccagccatgcgttttgtaattgatgctgcggtagaaaaagcctatcaaggtcaacgaaaaattgactggttagagatttatgcaggggaaaaagctaaccgactttacggtgaaaacacatggctacccgaagaaacattagcatcaattaaacagtatcatattgcgatcaaaggcccattgatgacccctgtcggcaaggggattcgttctttaaacgtagcaatgcgtcaagagttagatctctataattgcttgcgtccaatccgttactaccaaggtacgccaagtcctgtgaaatatccagaattagtggatatggtgatctttcgtgaaaattcagaggatatttatgctggggtagaatgggcggcaggttcccatgaagctgaaaaagtaatcgcttttttacagcaggaaatgggcgtgaaaaaaattcgctttacggaagaatgtggcattggtattaagcctgtttcaaaagaagggactcagcgtttagtgcgggctgcattacagtacgcgattgataatgatcgtaaatcactcactttagtgcataaaggcaacatcatgaaatttaccgagggggcatttaaagagtggggataccaagttgccaaagactttggtgcagagccaatagataatggctcttggcatcgtttaaaaaatccaaatacaggacgagagatcatcatcaaagattgcattgctgatgcttttttacaagaaattttattacatccaagtgattacgatgtgattgcaacgcttaatcttaatggtgactacatatccgatgcacttgcggcacaagttggcggtattggtattgcacctggtgcaaacataggggaagaggcggctatttttgaagcaacgcatggtacagcgcctaaaatcgcaggtcaaaacaaagcaaatccaggctcgatcatactcagtggcgaaatgatgctacgccatttaggttggactgaagcggcagatttagtggtaaacgcagtatccaaaaccatctcaaataagacagtgacctttgattttgcggaaacattagagggggcaacactccgtacaacttcggaatttgcccaagatattgtcgccaatatgtaaccacttatacacatagagataatcatgcaattttgtgatcttgttaacaaaatgtaaaatttgttaaatttattgcttgtcgtttttactctctctgttatgattatctcgtcgctcattttttatctatattgaagtggggatcatcattatgtctttcttaactgaataccaaacacacgtttttgaacgagctgcacaaggtattgtgccactgccattaaattcagcgcaaacagcagagcttattgaattacttaaagaacctgctgatgcagataaagcattactcttgcacctctttgaaaatcgaataccagcaggggttgatgaagcagcctatgttaaagccagctttttagcagccttagtaaaagggcaagcagtttcgccgctcatttccccacaacaagccgtcagcttgctaggcacaatgcaaggggggtacaacattgaaccgcttgttgaagcacttgatgatccaaaccttgctcctattgccgtcaaagcactctctcatacgctcttagtatttgacagttttcatgatgtggcagaaaaagcgaagcaaggaaaccgctttgctaaagaagtattaacctcttgggccaatgccgattggtttttatctcgtccaaaattagccgaaaaactcacactgaccgtgtttaaagtgacaggagaaaccaatacagatgatctttcgcctgcacaagatgcttggtcacgcccagatattccattgcacgcactggctatgcttaaaaatgaacgggagggtattgaacctgaccaagctggtgtagttggcccaatgaaacagattgaagcccttaaacaaaaaggttttccacttgtttatgttggcgatgttgtaggaacaggttcttcacgtaaatcggctacaaattcggtcttatggcttatgggaaatgacattccttacattcctaataaaagggctggcggtgtggtattaggcggtaagattgcccctatttttttcaatacgatggaagatgcaggctcgttacccattgaagtggatgtaagccaattaaatatgggcgatgtaatcgacctctatccctatgagtgcaaaatttgtaagcatggcagtgacgaagtattagcccagtttagtcttaaaacgaatgtgcttcttgatgaagttcgtgcaggcggacgtattccattgattattggtcgaggtttgacacataaagcacgcatggcactaggattgccagaaagtgaagtgtttgttaaacctcaaatacaggctaaaacaacagtcggctacacacttgcacaaaaaatggttgggcgagcttgtggcgtggagggcatacgcccagggcagtattgcgaacctcgaatgacaagtgttggctcacaggataccacaggtccaatgacccgtgatgagcttaaagatctcgcttgtttaggtttctcagctgatttagtgatgcaatcattttgccacacggccgcgtaccctaaacctgtagatgttgtgacacatcataccttacctgatttcattatgaaccgaggcggtatttcactacgtccaggtgatggtgttattcactcttggcttaatcgaatgctattgcccgacaccgtaggtacaggtggcgactcacatacacgttttccgattggcatctcatttcctgcaggttcaggcttagttgcctttgcggctgcaacaggagtaatgccattagatatgccagagtctgttttagtccgttttaaaggcgaattgcaaccaggcattaccttacgagatctcgtacatgcaattccctattatgctattaaacaagggctattgacggtagaaaaagcgggtaagaaaaatatcttctcaggtcgcattttagaaattgagggattagagcaccttaaagttgaacaggcttttgaactttcagatgcctcagccgaacgttctgctgcggcttgtaccatcaaattaaatcaagaaccgatcatcgaatatcttcagtctaatatcatcttactaaaatacatgattgccgagggttacggcgacaaacgaacccttgaacgcagaattaaagccatggaagagtggctggctgtcccacaattattagaagcagacagtgatgctgaatatgccgctatcattgaaattgatttaaatgacatcaaagagcctattctttgtgccccaaatgaccctgatgatgctagaacactttccgaagtgcaaggtcaacaagtcgatgaagtctttattggctcttgtatgacgaacataggtcatttccgtgccgcaggtaaattgcttaaccagcatcaaggcatgatcccaacacgtttatggattgctccaccaactaaaatggatgcaacactacttagtgaagagggctattacagcatttatggcaaaagtggagcaagaattgaaataccaggttgttcactttgtatgggaaatcaagctcgtgtagccgacggctcaaccgttgtttcaacctctacacgcaatttcccaaatcgcatgggtaaaggctcttttgtctatcttgcttctgcagagcttgcggcagtctgtgcattactaggacgcattcccacatggaaagagtatttagattatgtacaacgcctagaggcagataaaacggatacataccgctacatgaattttgaccaaattcaacgttatacccaaaaagcagataacctcatttttcaaacagcggtttgattttgcataaaatttacgataacagggaggacaaaatgcctaaactacacccgactttaactgcagaacttcaccttaatgatgggcgtaaaattccattgcccgtttatcagagtaacttaggttttgatgcaattggcgttgaggcattacaaaagcaccaactctttacctacgatcaagggctaacctctaccgcactatgccaatccagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgccaatccagtatcacctacattgacggcgaacaaggtgtcttactgcaccgtggctatccgattgacgagcttgctttaaataaaacctatcttgatatcgcctatcttcttctaaatggcgaactgcctacagaagaagaattggctgagttcaaaaaagagatctgttcacattacatggtaaatgaacaatttacccgcttgtttcaaggtttccgccgagattcgcacccaatggcggttatgtgtgcagcaagtagtgctttagccgcattctacaatgacatgctagacagtgatgacgaagcacatcgagaaaaaaccgccattcgcctcttagccaaaatgccaacccttgcagccatgtgttacaaatacaacatcggccgcccatttatgtatccgcagtaccacttatcctacgcaggcaacttcctacacatgatgtttgcaacaccttgtgaaccttatgtggttaaccctgtactagaacgagctatggatcgcatcttcacacttcacgcagaccacgaacaaaacgcttcaacatcaacagtaagaggcgttgcttcctctgggccaaacccatttgcttgtattgcggcagggattgcatcactgtgggggccagctcatggcggagcaaacgaagcctgtatcaaaatgctacaggagatcggcacggttgaccgtattcctgaatttatcgcaagagccaaagacaaaaatgatccatttcgtctaatgggatttggtcaccgagtatataaaaactacgatccaagggcaaaagttatgcgggaaacctgccacgaagtccttgcagaattaggaataacaacaccattacttgaagttgcaatggaactagaacgcattgccttaagcgatccttatttcattgaacgcaaactttatcctaatgttgatttctactcaggtattattttacaagccataggcattccaacttccatgtttactgttatttttgccttaggcagaacagtcgggtggattgcaaattggaaagaaatgtgcgaagagagcctcaaaattgtccgtccaagacaaatttatacggggtataaagaaagacatattaaataataaaacgttgagataaatagttgctaagatcgtattggttcttagcaactatttttgattctatatgtagaaaggaaattaccctaaaattttattgagttcatcgcttatagattctacagattgagtaccatctaaacggtagtattgagtatttcctgcttcagcttccgtagtatagtacgctatcaatggtttagtctgtttatgataaatcgttaaacgttctagtacagtttctggtttatcatcctgacgaataattaggtcttcgccagttatatcatctttaccttctactttcggtggattatatacaacatgatatgtgcgaccagatggctgatgaactcgacgtccactcatacgctcaacgattacttcatctgccacatcaaactctaatacaaagtcgatttttacaccagcttcttttagtgcatctgcttgtggaatagtgcgaggaaaaccgtctagcaggaaaccatttgcacaatctggttgagaaattcggtctttaactaaggcaacggttaattcatctggaactaattttccctcgtccattaatgctttgatttgtttacctaactctgttccttccttaatggcagctcggaacatatcccctgttgaaatttgtggaataccaaatttcttcatcataaatagggcttgtgtacctttgcctgcaccaggtgctcctaataagataattttcatagtaagacctcttaaaataaaaatagtggagtagattagtaaccctattgattactgcttgagttgtgaattttattatgtaaatgctcacttgttaagtcagtttaaattaaagcgagctaaaaaataccactaaaatcaaaagcggtatcacatatttaacatagttaaaccacaaattcgttaatgttttccctgcccctaattcttccttcgcttcatcttttaagacaaaaccaacgaaaattgcactgccaagagcggtgagaataaataaaatgttaccgctgatatagtcaaaggcatcaaaaatacttttgcccataatggtgacatctttccagacattatcgcctagtacagatggaatatttccaaaaatgaaaatcagggtaagtgtccagaaaatcgctgctttacggctcattttggttttttcttgtaaagcggtgatgatcacttcatagatggttaatgaggtcgtcaatgctgcgaccactaataatccaaagaaaataatagcaaagatcgtaccgctccacatattagagaagacaattggtaggctttggaagacgagagttgagcctgaatttggggcaatgccaaagctaaagagtgatgggaagatcataaagcctgccatgactgcaatcacggtatttaatacccctgtgattgtcgcggttctcactagattttcttttttatctaagtagctagaaagggtaattaatacgccgaaacctaagctaagtgcaaagaagacttgccctaatacaaagacaaacaattgcggtgtaatttttgagaaatcaggcattaaatagaatttaatcccttccgctgcccctggtaaagtgacattacggatcaccataataatcaagaagataaagagtatcggcataagatatttaactgaacgctcaatgccatcaacaatgcctttgactaagatgaagtagtttactaatacaaacaagccagtataagccaaaatggtaactgggctgttaaaaatactctctttaaaataagtagatgtagtttctacggtaacaggtgatgatagatctaaaccgcccgttacaagactgccgatatagtttaatacccaaccaccaagcaccatatagtaagcaaggataccaaaagatcctaataatcccatataacccaaaattttccacgcagggtgaatggctttaccattcgcttttcccgtaaaggcatcaatggcatttactcgcatacggcgaccaatcacattttcaaccaagatcatcggaataccgatcacgatcattgcgatacaaaatagcgcgacataagctccgccaccattttcaccgactaaataagggaaacgccacgttgcaccaaaaccaacggttgcacctgctacggtcataatatatgccaatcgatttgaccacgattggcgttcttggggttgtgtattcatattttttcctactgcatacaaaaggaagttaagagaacagagcaaaaagttcatcgactttaattcgagagtcaatggattgaccgatgtgacgctgaactttcagttttttgatttttgctccacggtagatttgccgagtaaactcggtatcgtgatttgaaattaagacagggattttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaggcggatcgcaatagaccgcataatcatcaggattatctaatagatattgaaagacttgatgaaaatcggcacagataaataccgctttctgagctttttccgcaaaaaagcgtaactctttttcagggaaataatgggttttataatcgccaaatggcacgttgaactcatttttttggttatagcgacataaaccattaaaaccaaaacggttgagataaagaaacagtgctgaacgacgtagcagatcttggcaagcattaaattccttacgtcgctcataataaaattttgccgtatttgcttgtggatcattaaacaaggcttgcgattgatggatatagctttccacatcagctttaatcacattaaagagattaatcagatcagggttaatgtcagcaagaatatagcgttcaaaatgtgtattaagaaaaactgagccagccccaacaaaaggctcaactaggcaagccttttggggtaggtgccgattaatttcatcggtcaggcgaaatttcccacctgcccattttaaaaaggctcgctgtttcattgttaaaacttaggattgagtaaatcgacggatagcatctaacacttgagtttcggtcgcttgagcggtgacataagctgtgccaagtgattttaataaaaccagacgcaactgaccgcttagtacttttttatctcgccacatataaggtagatattcttcaggcatcattccatctggtgaaatggttggcaaggttgcacgagcaatcaatttttctaaacgagccacatcttgttccgtaagatcgcctagaatatgggacaaggcagctgcttcaagcataccgactgcaaccgcttccccgtgtaaccagttaccgtagccaagatatgcttcaatcgcgtgcccaaaggtgtgacctaaatttaacaaagcacggtcgcctttttctgtttcatcgcgagccactacatcggctttcagttggcaacaacgttgaatacaatactctaatgcagactgttcaagggcaacgagatcgtcaatatgctgttcaagccattcaaaaaattgagtatcaaaaattgcaccatatttgatcacttccgctaatcctgcactcacttcacgtttaggcaaggtttttaaggtatttgtatcaacaatgactgaaatcggctgataaaacgctccaatcatatttttgccaagcgggtggtttaccgccgtttttcccccaacggaagagtccacttgagctaataaggtggttggaatttgaataaaacggataccacgttgataagacgcagcagcatagccagccacatcgccaattacaccaccacctaacgcaattaataccgaatcacgattgtgatttttttcaagtaatgcggtaaaaataagattgagtgagtcaaggtttttatattgctctccatcgggaattaaaaccgaatcaactttacaaccgatagctgttagcgtttgttctactgttgcaagataatgggaagcaaccgttggattagacacgatcatcaccttatcccctgattttaacgggtgataactcatcggatccgttaataaccctgcccctattgcgataggatagcgacgttcttttaattccacattaacttgcaacatatagacttccctgattactgtaaattatcaatcatatcaatgatttgcgttgcgactacttttgcactttgttcatcagtttgcaaaataatgtccgcaatttcttcgtaaagcggattacgaattttcgccaattcaactaacgtttgatatggatcttccgtttgtaataacggacgttttttatcacgttgagtacgctcaaactgtttatccaccgtagtttcaagataaaccacaataccacgagctgaaagcacattgcggttatctttagacaacaccgaaccaccgcccgtcgaaagcacaagaccttgagattgtgtcaactcattaatgatacgctcttcacgcttacggaaaccagcttcaccttcaatatcgaagatccaatcaatatctgccccagcacgctcttcaatcacagcgtctgagtctaaaaaatccatatttaacatttgtgctaattgacgaccaatcgtgcttttacctgcacccatagggccaattagaaagatattacgtttttctgccattatttgttctataaataaaaatagagtgaaaaattgatttgtgaatttttagaaaaaacagaccgcttgcacatacaagcggtctgttttatgttgaattttgtaaaagtgattaaaattaaaacacttatcttataaatttaccacaaatcgcccaaaataaagatgggcgatattatctcaataaatcgccctacttttcaactggaacaaagagaattatcgaattttagaataattctttactgattttttcagttccttcaggatttgtacctagaggttgttcaagtgccttctctacaatataacgtttcttaggttcagttcctttaatgaaatattcgctcatatttccccctaatagaccgcttgtaggctcaatttgtaattctatgatattaggtggcaactgttcttttcgctcttctttatccgaaagagccactttcatatacttaatccacgctggcaacgctgtttgagcgccagcctcaccacgtcccaattcacgtttattatcatcaaaaccaacataaactgtcgtcacgaggtttgagccaaagcctgcgtaccaagcgatcttggcgttatttgtagtccctgtttttccaccaatatcactgcgtttgatctcatttgccacacgccagcttgttcctttccaaccttgactagcttcacctgtaatagctgttttcaatgcacttcgcattaagaatgcaatttccccactgataacccttggggcataatgcacttctcgattaacagctatggcatctgccatcaagcttggggcattttgtttggttttagtggcaatatccagttcaggaataacatcactttcatcatctttaggaattgcggtttcttctgtagtttcctttactttgacaaaatcaaaataggttggctctggataaatgactggcttatcatcacactctaaacaggcaattgcagggtttgctttaaagagttcattgcctgtactatctaaaatacgaccaatgatataaggttcaatcaaatagccaccattatcaaacacagcatatcccctagccatttctaacggcgtgaaggacgctgcccctaatgccaatgcttctgtcgcttgatattgatctttttggaagccaaagcgttgtaagtaatccgctacatactctacgccagccatctgaactgtacgcaccatcatcacatttttcgacttacccaagcctactcgcaaacgtaacggaccttcatacacattcggtgaatttttcggtgtccacggtttttgtcctgcttttgtaatagtaataggcgtgtcgcttagagtggttgaaaggctcaatcctttatttaatgctgcagcatagataaaaggtttaatcgaagaacctacttgcactaaagattgtgttgcacggttaaaacggctttgttcaaaactgaaaccgcccacaatcgcttctatcgccccgttatcactatttagtgaaaccagtgcagagtttacatctggaatttgccctaattcccattcacccttactattttgatgcacccaaatttgttcaccaacattgatcacgtcttttacttgagtaggtgctttaccttgggcggagtcattgataaattttcttgcccaacgcattccagacattttaagctcaacacgctcccctgttggcaacatcacattcgctttatcttttgaaattgccaatactgccgcactcgtaaatggctcagagcttggcaatttgcttaggtgatcgatgatcttttcttcgtcccacgctttctctttagggttccacagtttctcagctccacgccagccgtgacggcggtcgtagtcaatcaagttattgcgtagtgcatcttgtgcttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttggtcagctgataacactgttgcaaacacttggaaacctttggtgtaagcgacttcttcaccataacgttttaccatttcttgacggatcatttctgtcacatagtcggcgcgaaattctaacgcagcaccgtaatatttggctttaatcggttctgctttagcctgttcatactgagctttggtgatttttccgacttctaacatacgcccaagcactacattacggcgtgcttctgctcgtttaagcgagaaaagagggttcatcgtggaaggggcttttggtagccctgcaatgatcgccatttccgataaggttaattcttctagctttttaccaaaataggttttagccgcagccaccaccccataagagcgataccccaagtaaattttattaagatataactctaaaatctcattcttagacagattttcttcaatttctaacgccaaaatcacttcttttaatttacgctcaagtttgcgttctggcgaaaggaaaaagttgcgcgctaactgttgcgtaatggtactcgccccttgcgtatccccttggcttgaacgccaaacggcacgcataatgcctttaggatcgatccccttatgttcataaaaacgggtatcttctgtcgcaataatcgcatcaattaaggtttgcggaatatcggcaagtttcacaggaatacggcgttgctccccgacttccccaatgagtttaccgtcagcggtaaaaatctgcataggttgttgaagttcaacggtttttaggcttgctacatcaggtaaatcttcttttaaatgaacataaagaaaacctacagcaactagacccacaattattagtgtaagtaaagcactaaatatgatttttacgatcttcatcgaaaaattctcttttgctaaatgacgaaaggataattctaggtcaagataacctaaatccgaaaactgccccctgcttatacatcagtggggtagaaacgagtaattatagttttaattgacctcataatctattttttattcgagggaaatatgggtaaattctttcaatttcgtacaacaccgcaactcaaacctattcaagttggctttttctggcaagaaaataccgcttgtatcgtctattttgaacaagaacagccccactctttttacttttcaagcaaagtagaagcggatagtttcctacaacaatttccctttaactatcagcttattcaaggcatttctcatcagcatatttggcgaaaaaccttgatactgccagagctacattcccatttaaaacaagctgagcaaatcattcgtgtactcaaacagagcctacctttagctttatctgaagtaaacattgattaccacattacccctttagccgaaagccacctttgccagcttaatctatatgctctaagaaaaagcaacagctttgacccaacggctattttagattgcgaactctactgcctactacgagcggtaggatttctgacaaaaataacggaaacgcaaattcttgaacacagtttccacattcaagacaaatttattcactttcaaaatcaacgaattatcgtcgaaaagcagaataatagcaccaaaccaatcattgaagtggacggcttgccccaagctcaacatcttccccacttttatccttatctcattgcattaggagcaagtttatggaatggcaaggcatcaatctaaatggctaccgccaacagcaatggttgaaacagtcgcaaaaaaacctcaagcatctcactgcttgtcttgtggttagcgcactactggcgttacttatcagttggcaaaatcaacagcaacaacatcaatttcacactttggctcaacagcgacaacaaagccaagagcaacaaaccgcattaagccagcagattgaacaactgactttgcaatcacaaaataaaagcacacaaagcctagagaacagacagattaccgcatttttgaattatctgttaggcattcaattatcagggattattgagatagcccaactataccaagcagaaaataccgtctttaaactcaaaggcaaggtgtctagccctactcaatttagccagcttgaacaacaattaaaagcaatgaattacatttatcaaatagaacaatttgaaacgcgtgaaaaaagcgagattgaatttagcctacatattgatttaaaggaaaaagaatgaaattgtccttagccaagtattatttaatgccagaacatccattatatcgtggcttatattatttaaaccaaaataaaggatttattctatcgggaatatttttattgattgtggcatttccagtaggaaattatttttatcttaatcagaaaatagaacaacaacaaaaacagctcactgaagttaaacagattattgagcataaacagcaacaattaaaattattacaacaacgctatcaacttgctcaagataaaagtgaattattaaccaaaataaatcaacaaattcagctgattttagataaaaatagcgtagaaattgacagtattcaatggaatatggaagaaagaaaaatctatttattaattagccaatctacacaaaagatatttaatgttattgctgagcttaatcaattaacaacagttaaatttcaggaaattcatttaactaaaaaaacaaaacagaaatatattcaactcaatgccactttactttttcaagctgacacaggagaaccgtaatgcgattatgctttttctattttgtctttctaagtgctgttactatggcagatcctttttatgccaaggaaaatgcccaagatcagccacaaacggcaaaagatcaaaacaaaacgaccgcttgtacgccaacagagaaggtgaacgaaattcacctcaccacagattttgataaattacagcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcaccacagattttgataaattacagcttatcggcattattcagatcgacgataaaatccgagccatttttatagatgataaaaaacagcttatagatttatatcctaacgactatttaagccattcctttattcaaattaaagagattgattttaaatcggttagttatattgattggcaaaaaacagaaaattgccaatcccctaaattgtttacttcaaaattttaggagtatcttatgcgttatttattcctgctattctttgctacttttcctgtattagcaaaccaacaaatttcgctttctataaaaaatgcccctacggcagaaattattggttatttagctgaagaaacgggaaagaatattacgatttcagatgagattaaagatacaaaaaatttcagagtagaaaaaagccattttgatgagatattaaatagtttaatcaaaacacatcaattaaatttaaaaaaagaaaatggcatttactatattcatcaagcccaagaacataaacaacatactacggcacaattagttaatgctctgcctaaattaatcaccaaaacaatcaagttacactattccaaagcctctgaagtaatagagtctttgacaaaagggcaaggcaacttgctatcagagaatggttatcttcattttgatgatcgcagtaatagtattatcgtcaaagacagtgccgcatcggttaaaaactttactcaacttattgaaaccctagataaaccaacggaacaaattgcaattgaagcccgaattgtcacgatcagcagtgaacatttacaacaacttggcgtgcgttggggcttattttcccctaacgaaaatcactacaaattggcaggaaacttagagggcaacggattaactaccaacaacttaaacgtaaattttccagtaaatccgtccgcttccgttgccttacaaattgccgctatcaacagccgtgtacttcatttagaactcaccgcattagagagcgaaaataacattgagatcattgcaagccctcgcttactcacaacagataaaaaaccagcgagtatcaaacaaggtacagagattccttatgcaatgtacagtaagaaaaaggaaatcaccgatattgaatttcgtgaagcggttttggggctagaagtcacgccacatatttctaaacaaaatcagattttgttagatcttgccattagccaaaattcgccaaataaccagatgaacaatatgatggcaacgattgataaacaagaaattaatacacaagtccttgctaaacacggcgaaaccatcgtattaggcggtatttttcaacatctgatcgccaaaggcgaagataaagtcccgctgttaggcagtatccccgtgattaaacgcttatttagccaaaaccgagataaaatctctaaacgggagctggttatttttgttacgccttatattgtaaaatctgaaaaaatgggagcggaaaagcagaaataacttcacctttattttgcgggaaaaggctacaatgtgttagaattgccgactatttttatttcgataaattgaggttttatgaaagtttctccccgtcgtcgtgcgagagaatgtgcggtgcaagcactttattcttggtacatttcgcaaaatagcattgaacaagttgaattagcctttgtgaccgatcaagatatgcaaggcgtagatatgccttatttccgtaaattgttacgcggtacggtagaaaatgtagatgttattgatgatattcttcgtccatatttagatcgtgcagataatgaattagatccgattgaacgtactatcttacgtttagccggttatgaactaaaatttgaattagatgtgccttacaaagtggcaattaatgaagcgattgaagtggcaaaagtattcggttctgacgatagccacaaatatgtcaatggcgtattagataaattagcccctgcgttgaaccgcaaataaggattacaatgggcgagtttgatttgataaagcactattttagtcgtgacaagcggttagatcgccacgatattttactttccgtgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccttagtgcttggtacacattttcttcctacgatttcccctgctgatttagcttataagtccgttgcggttaatctgagcgatctcgcagcaatgggggcaaaacccgcttgggtttccttggcattaaccttatccgacgttgatcatcaatggcttgatagctttagccaatcactttttgctattttagccgagcatcaaaccgctttaatcggcggtgataccaccaaaggtcacttggcgatcaccttgaccgcacaaggctttctgcctaaaggcaaaggattattccgccataaagcacaggtgggggatcttatctatgtttcagggcatttaggcgatagctcggcagggttagccctgttgctcaatccgccagccacattgaccgacgctcaacactacttaattcaacgccatttacgcccaacacctagagtgacattaggacagtgtttgctcaactatgcacaatgtgcgattgatatttccgatggattgttagcagatttagggcatattttagaacgaagtggttgcggtgcggaaattaatgtggataagttaccgttttcagcaccattgttacaaacttattcacaagaacaggcagaacaatttgctttaacgggtggggaagattatgaactctgttttaccgtatcggaagacaatcgttctgcaatggaacaagccgttgcagatttaggcatttcttgccattgtatcggtaaaatcaccgaaacaagcggtcgtttaaccttactaaaacacggcactgtttatccacagcctaatcaagttggctttgatcattttaattaacaatgaagataaatttaaaaaatcctattcattttctcgcattcggctttggttcagggctaatcaaacctgcccctggtacttggggaactttggctggtttagggggggcgatcttgttgtggcacatcacagaaagcacgctcttttttgtgttactgagcttgatcacttttgttgctgggtgctacatctgcgacaaaaccagtcacgatcttggcgtacacgatgatgggcggatcgtctgggacgagatcgttgcggtgtttgtgatcttcggttttctgcctgaacacaactggctctattatctgctgacctttgtcactttccgcttgtttgatattctcaaaccctaccctatccgctattttgatgaacatctgcaaggcggattaggcattatgcttgatgatattttagcggcaatctactcgattattactctctatttgatctcttggtgcatttaaaatgtggacaatttttttcgtacaattactgggcttaattagccctggtcctgattttttctatgtcagccgtaaagcaatggcagatactcgccgaaatgcgattttaggtgctatcggtatctctatcggtgttgcattttgggcattgctcactttgtttggcttggcatttctcaataaacatttcccttcatttcaatttgtgctgatgatttgtggcggaagctatcttgcttatagcggcattcaaatggtgcaaatcacgaaaaatgcggaaattggctcggcaacatcgacatcacaagcaacttcaaccgttaaagaaattctaaaaggattaatgattaaccttgccaaccctaaaattgtggtatttttcagcagtgtgttagccggttacgttgctaatctctctgcattagcggacttacttgcggtacttgccattttagtgggcagtgcagtggtttatttctggcttgtcgctttgctattttctcgaccagctattcgctatttttatgccaaatataaccgctatctagataattttgctggggcagtgtttattttatttggggggaaattggtgtatgagggggtatttagcctatggatattctcctaaatttgtgaggtagacaaaggcatcaacaggtatgtcccataaaaatgctgtaaataagatataatgtatcaatgtgttagttattcaccgaactatatgaggatttgccgtttagtattcttatacatagtggaaatttccctaagtataaaacttcatagcacgctaggtaaaattaattacattaatacttaattcctacttgaaaagtcaggaataaagcactatcttgtgcacgtcttaacgctttagatgttatagaagcgtttcttttttattttagttaaggaaaaattatgagtagagtaattcatacaactgacgcatcttttgaacaagatgtattaaaatcggatgtcccagtattattagatttttgggctccttggtgtggtccttgccgagcaattggtccagtattagatgatttagccataaatcttggaaataaggctcgtattgtgaagatgaatgttgatgaaaatcagcagattccagcagaatttggtgttcgtagtattccatttttattgatttttaaaaatggagaagtcgtagctcaacaagtaggggctcaaaatttgccagcatttttagaacatctatcttagtttctatattaaaaacccctatattttagagtctttctgagtatagctattaacatctcacggttagattgctctaaccgtgagattaatagcagacattaaaaaatcaaatcattactgtataagagggataattaattctcctcaataaggttgcagtttctttaatgtcctatgcgatatttactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactgggtttgatggtgatgaagagtaatcatttataggtggggattcccccaccattatgagaaatgaaaagccccaaatcgaaaggtttggggggggtgttttatctttgggagagtagcttagtacttaatcttgccacggcacataactgttgcgcatcatctcgaatttctatttgccacacttggctctctttacctaaatgtaacggtgttgctctgcccgtggcttttccgctttttatcgcttttaaatggctgatattcaattctgtgccgacagggatttgattttcttcacaacaaagtaatgcagctgcagagcctaaggtttccgctaaagtcgcagaaataccgccgtgtaataagccgaatggctgtgttgtgcgatgatcgacaggtacggtcgcttctagactatcgttttgttgagcggtaaattcaatgcctaaatgcgaaatggcagagtgttggcagagttgattaagttgctcaatcgttgtgttttttttccaaatcatttttattttccgtatatagataaaacaaaagcctgttcaaataaacaggctttatgtataatttttcccaatgttttattgtttaaacataataaaacagaggcggatctgcgaaaaatcagtccgccagtaagcacctagcgggctgttttagtagatctttacgtttaatgttatccgtggagataaaaacaatgaaacgcattcttttgtggttaattgttattctgctatgcctgttacttaagggtagtgcgggctaagcagtgaaaccgagcaggaacggtgaccgccgttcctgtttttattttatgcctattttttatctaggtcaaatcacttccaacaacgcttgcacagggtgtttgagtagctgatgttccattcgtttcacttggctacggcaagagtagccagtggcaaggcaacgggataaggttttgccttgtaacttcacttgccacgattgtgcgtaaatctcttttgacattgcaaggtgtttggtttcgtgcccgaatgtgcctgccattccgcaacagccgatattttccgccgttaaggtttcgccgaaatgggcgaaaatctgttgccactctttcaagctgtttggcagcgaggtgctttcggtacagtgtgcaaataagtgccacggtaagcgatcggtttcggctgattttttgcaatggtcgagagtgccgtttttcagttgagccaacagccattcgtgagccagcaacaccttaaattcgccacagtcgtcttttaaaatttggcggtattcttcacggtaaatcaaggttaaggcaggatcaacgccaaccattgcaatgcctaatttggcaacacggtttaacaattcggcttgtgtgcgagcggtgttggcaaacttgtgcaaaaagcctttgatatattgtgctttgcctgttgggttgaacggcaacacaatcgctttgaagccaagtttttgggcgagctgaacaaaatctgccaccactttggcatcataataagaggtgaacggatcttgcaccacaaggacatatttgcaaatttctgtgtctagttgaccgcttgtcgccagctgttccagctcttctaaggttttgccttgatagccgatttcaattaactgttgctgtaaggtcggcacggataacgccggcagatcgaccattccgatggttttgcttgcaacggtttcagccagtttgttggcactgaagaagttaaacaacttcggctgttttgccattatcggtgcgataaattcgaggttcgccaccacataatctttcagcggacgcagataacggcggtgatagagttcgttaaattgtgagcggaacgtcggcacatcaatttttatcgggcattggctggcacaggctttacaagcaaggcaagtatccattgctgatttcacttcgtgggagaaatcatactcttgtgattttcgccactgattgcggattttcttcgcaaaatcgactaatttcgccgatgtttgctgtttttcaaagatcaactcatcaggggaaacattttgttccgccagtaaacgtagccattcacgcactaaagttgctcttcctttcggtgaaaataggcggttgcccgacactttcattgacggacacattgtactgtgtacatcaaaattgaagcacaaaccgttgccgttgcaattcattgcccctttaaaggcttctcgcacttgaataggaatttgtctgtctagatcggcacgcatttgcgaatcaatcgaataaaggctggcttggctatctaacggcgtacagattttacctgggttcaagcggttttgcggatcgaaaagctgtttgatataacgcaactctttccataaggtttcaccaaagaaccgctcaccataggcagaacgcatacctttgccgtgttcgccccaaatcaaaccgccgtattttgcagtcaattcaaccacttggtcggagattgccttgaatttggcaacttgtgatttgtcgcataaatcaagggcaggacgaacgtgcaacacccctgcatcgacgtgtccgaacataccgtaatctaagccgtgatcgtcgagcagttggcgaaattccacaatataatctgccaaatgttcaggcggtacgcaggtatcttccacgaaagcgatcggttttgcccaaccttttgcgttgcctagcaaaccgaccgcttttttccgcattgcataaattttttcaatcgaagccaaatcgttgcaaagttggtagccgatgataccgcttgtgccgtcttggattttttcatctagagcttggcacagcttggcaatccgcgcttcattctgagccttatcatttgaagcatattcaacaatgttaatccccaaaatcggattgtgttcatcttcagtgagcagatccgacaccgaatgccacacaatatcttgtttggcaaggttcagcactttggagtccaccgtttcaaccgatagggcttgggcttgcaacataaaaggggcggaacgtaacgccgcatcaaaggaattatatttaatgttaatcagcgtgcggtattcaggaagcggaagaagattgagcttagcttcgcaaataaaggcaagagaaccttcggagccagttagaatacgggttaaattaaattcggagagaacgtcgttaaatacatttttcagatcataacccgtcaaaaagcggttcagttgcggtagttctttcagcacggtcgggcgtaacgcttggcaacgttggaagatctcgctatgcaattttttgccattcgccgtgagattaagttgatcgacatttgcaaaaaaatcatcggttttgaccgcttgtgtttccaaaatatcgccgttcatcaacaccgctttaatcgccaaaatatgatcggaagtcttgccgtattgcaacgaaccttgccccgatgcgtctgtgttgatcattccgcctaaggttgctcggttgctggttgaaagctcaggggaaaagaatagcccgtgcggtttgagaaattgattaagctgatctttcaccacgccagcttgcactcgcacccaacgctcttgtacattcagttccaaaatttgagttaaatgacgagagagatcaacaatgatattgttgttcagcgattgcccgttcgtgccagtaccgccaccacgcggggtaaaggttaaggcttggaatgcggttttttgtgccagtttggttaaaatcaccacatcagcaacggatttcggaaacaaaatcgctcggggcagttgctgatagacgctgttgtcggtggcaagagaaaggcgatcagcatagtttgacgcaatatcaccactgaaatgttgctgtttgagttcagctaaatatttctgaacaagcggattaagttgaggtatgtttgcaaggcgtgggatcatagttttttaatctgttaaaattttaacgagatcttagcaagattttcatttaatgaaaattactacaaaaaaattggcaaagcatttaaaaagttgcaatttattacatttacttacatttccttgagtgcttataaattgatttcttttatattaatgggataatagttgcattcttgcctcgttctttaagaaagaaaagacaggaatgtaagaaatttcagcctcgacacggcttctttgaaaaagttcgcttgtatttcggattttttttagtaaaatgtaggcgaaatttcgactttcttttcgtattgaagaatagaaagcgtagttaaagccttagcgtaatgattacgctaagaattttgtttaattagatgacgataatagaggatcatcaaaatgaaaaaatctttaattgcattagcagtatcaggtttagcagttgcttctgtagctcaagctgctccacaagctaacactttctatgtaggtgctaaagctggttgggcaacattccacaatgatattaaccaattaaactctaaatatnnnnnnnnnnnnnnnnnnnnnnnnnnnnnnnnnnnnnnnnnnattaaccgtaactctgtaacttacggtgtgtttggtggttaccaaatcatcgacaacttagcagttgaattaggttacgattatttcggtcgtgttcgtggtaacaaacaagaattccgtgcattcaaacactctgcacacggtacacacttaagcttaaaaccaagctatgaagtattaaacggtttagacgtttacggtaaagttggtgctgcattagttcgtaacgattacaaacgttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgctccaccttaatattcaactcttcaacattgccatcatactcacccctcaaatacaaactcaccgtagcaatcgacacgcctaatttatttgcaacctctttttgcccaattttggtgcgttccatataatcttttaatagttggtttttcatcgcttatttcctataatcaaagtctcttttttcatcaacaggcttcgttatgcttaaaactccacctgaccttaataaactcactaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacagatcagggcgaagctcagatttggctacttcgccattcgtgacttcttcaattttcttagcaagataagcaggcattggcgaatatcctgtttcaacttgtcgtaaataagatttagaaataccaagcttttttgcaaaatcagctttgaagccacgaggacgatctgacaaataactagttaagtccatcatcactcctgttaagtaaaaattagatttagtttagatttaactaaatacaaagtcaagtaaagtttattttttgcttatttaggaaatactaaatagaatgatttaaaaatgaaaagtgaggttagttatgattaaaaatatgactctgccagagatccgtagaaaaaaacttacagaatggttcagtacgagagatattccagaaaaggaaaaaagctacatatcacaattaaaatcaggaaaatcatcttttggtgagcgtgcagcaagaagattagaaaatgagtatggaatgcctagcttttatttagactatgatgaagaaacagaaagtgctattgtgtctgcaatatccattcaagaaacacattctcatcaatatcctattcatctaattaactttaaagctaaggctggtgaaacaggttttatcaatactaactatcccgaaattattcaatctatctatttctccttagatggtttgcttgaaattgtagggagaaaatcaagcaatggcattgagatgatcactattccaactgatagcatggctccaacaataaacaaaggtgatgtcgtttttattgataccacaatcaattattacgataacgaaggtgtgtatatttttgccattgatgatgaagtttatattaaaagactacaaaaaattccagggggcgtttatagagctttatcagacaacaagacttacgagccttttgatataaagagagaaatcttagatactgcaattatccttgggaaatttatccgagtattgccaataaaccctaaagatttgtagctattggcgtggcagttgagcataggagctacttgtagcaactattgaattttattgagtaaataggcgagttcgccataattaaaactggagaatggtatggttcctaatgatgtaataatcgtacaagagacagaaattcgggttacagaacgaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaactctgcccaatttttgataatttccgcccaaacaggacagatagacgttaacttactcaaatgatttcgcattgctggagcgacagtcagtaattgcatacaacgccttaaatccgcaggatcttgtggataacatactcgttttggtaccacatcaaagccaactacaaacgccattgttttactacttaaccctgtctcaccatcagctaaccattcaattatttgttgttgcattttgttcattttattttccctgcaatgccaaaaactcactttctttaatttcgactaagtaatctggtacttttgggaaatcatcaagatcacaatcttccccttttacagggatttttgcgatatattgcccattagcaataccagctaccgcaatataaagatttgtcccataactaacccaacaggataaaccaagttgttttaagctataattggaaaaatcaggagcttcattaagaatttctcgacattgtcgtaattttttatctaactccttacctgctttgtaacgacgatcaggttttatgacatttttccctttataccgctcaattttgtaacctttcatacttttcacatcgtttaatgcgggactatcgtcatcgcaaacaatcccatacatagatgtttcgctaccacaccagccattataaaaaggtattgttgcaaaaatttcctcaagtttttgattgcgtacttctcgcaagttttgccagttttcgtcaatcgtcttaagtggttctactgacatatcacccttaaaaaatctaaactcaacattactcatcattttctcctactaactcttccgcaacataggacggcaccattacttctttaatcttatacaacataacgccgtcagctccttgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcaccgattgtgggggcagagagtaaagatctgtgtcgttcaatccgtaatcttggcaaagttgatccgattttagtgtcagatacttcacaacttggcgaagtgttagatcaaattattcaagatggtgatttaattttggcacaaggtgcgggcaacgtgagcaagctttcgcgtgatttagcggaaagttggaaggcataaagaagatttaaaacaagcgataagatttcgagaaattttcgctattgtgtaattgtacaaaataatgtgtaggggcaaatcacatttgccccaaataatcatagtaacatcagggcgaatgtaattctctcctacggtaaatccgaaaatttgcaataatttcaatgaattaactgtaggggcacactgtgtgtccgttgttaaaatgggatatggtttattttgcggacacacgcagtgtgtccctacaattccccataataatgtaaaattcttgcaataaatgaccgcttgtaaaacataaataaggtaaaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggccccgaggacctgttggacccattgcacctgctggaccttgctcacccttagcacctgcwggacccgcaggaccwrctggaccnnnnnnnnnnnnnnnnnnnnnnnnnnnnnnnnnnnnnnnnggtcctgctggacctgttkgtcctgttgcacccgcaggaccaactggaccctctttcccttgtggtccttgtggacccattggacctggtgctcctgkttctcctcgytcacccytagsacctgcaggacctgcttcacctttnnnnccagcttcgcctctatcgcccttaggacctgctacccctggagcccctgctggacccgcaggacctgctggaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccatcgccccagccgcaacaccagccccaacgcccatcaaaccacgcccaacacttgcagctttatccccaaagctagatctcccaagctccgcatttaactctttgatacgttgtttcgtttgctcagaggcacggcgtagctcattttgtgaagccactccagagcgcttcaactgctcataagctgcacgggtttgcctaatttcctgctgtatcgcattttctgaacgaatacctaacgtttctctcgctcttgcaagatctgcagcactttttcttgcttctcggtaagcctgctcaatacgtttatttgatgattgcgttgccgtagcgaccttttctgctgcagtcacttgtgcctgactgctnnnnnnnnnngctcgctctgtatctttaaaggctttctctgcctctttgccgactttannnnnnnnnnnncttgcattgtctttggcattgagctcaagctgcactttcatatctttagccatggtaaactctttttaaattggatttaaacctataaaaaaggggctttacgccccaatttttccacgtcgagtaaacacaaaactttcgtgtttaacattattgctagggctatctgtcgcttgcttaggctgttttatgccttcaaactccaaataactctcaatccaagccgacaactcaatcagcgacatttgccacaccttatcagcaggaattgcaaatttcgcaaacaaaatcaccgcttggcgatattgtttaaaggcttccgctacgccaaaccgtcctgacggttgcttaggttgtctaggttcgccccatttccgataggcttttttttaagcatcaatgttgcctcaagcagttgccaataatcatccgtggctaaatgctcaaataaaaattgtgcatcaacgatttctgcaggaataccgtcaaaactgacctgctgagaaagataagccatatccactaagattgcctctttatggctggcattttcttcgtcaatgcccattgcatcaatcatctcaagggcagtgcattgcccacccattgtaagtaaacgcacatttgccnnnnnnnnnnnnnnnnnnngatactcaaaccctaaaccaagctcaactttcattactcaacaacctcacgcaacgcacctagttgaatatcaatttgcgattcattgtctaccgtataggaagcacccacttcaatggtaaagcaccccaaataagatgtccgtttttccgcattatttaacgggtatttggtaagtttggcatctttgatatttttccaatcaatcaccgtaccatctttaggttctaccgcagtaatagataacgtgatctcttcaataccttgagcataccccttagctcgcccagcgctattcattgttttaacgaccttacgccctgtttgaattttgacatctaacttcgtaatatcaatttcaaccccatcgacctcaaggacacaagaaccttcaaagacttcagccataatctactcctataataacaatgtgattttattgcggataacgtgcaagccatttacaacatctgcaggaatatccaagtccaaatacgttgggtcttgggcattacgctcaataaccaaacgagatttccagttatctacattctcaataatctccaactgctccaaacgataaagcacatcaaggatttctgagcgaactttgcgaataacacgctgtgtatttttagctctagggaaacgtaaacgttgacgagtttgaattgccttacgcacataatctaaagtacgaatagtagttaaatccaaataacttggatcgtctgtattcgtcactgattttgtataagtcgtaatagcgcggctaatctgaacacgattcaccacaacctcaagcggacttaacccattaaataaggcttggtttacctcactaaataacggcttctgtgaatcgtctaccaaacttaaccccttgacctcaagcgtattaagaggcttcgcaggatcttcctcacctgcaatcacagccccataacctgctgcaatcatcgcatttgtttccgtacaacccttgtaccacgcaatagagatacgttcagaatttaaacgagaagataacgttgttcctgtcgcaaaagtaccacgccaacccattacaccaattcctgctttatcctcaatcgggtcgctcatcaattccaaatgttggcgtagtgccgttgcattttcttcatctgaaaatggcgaaataatcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttcccatttatcccaaagcaccatattgtcaggcatttttaaaacagctttaaaatgggcggtattccacgctttactggcaagagtgcgattaagtacgctgtcgtaatgcaaaatcgtaccgatataaattacatctaacttaccgtccgcagagcctaacggtagtacagttttcttgagccaattatgcaatttgtcacgctgttcaggattgcgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacgaggcaagccgtgtcgctttaaatagctaatagactcaggtcttgctgaatccgcgcgtattacatactgctcaatgctggcaatacctttctgcaaaaatgtcgctgtatcatcaagctctaacccgactttgccagcctcatattcaatatacaattcatcmttaaacacccagcatttaaccgcggcagttgggtcttgagcaaaaccgaaatccaacccgtgataagggccttcaaaatcaggtaaaggcttaaactcaagctcttggtattttcctctaaagacttgagcctcgctttcttcaagataatccccytcccaaatccarcgataagtcgcatcatctaaacgggctttatcycttaagcgttcttgctyyaayacatcaggaaaccacggattatcgctataattcatctcaacaatcgccatactttcgtcttgatgttgcctaaagcgtaaatccgttgccgaacctttcttttcagggttccamgtkarccaaatttccgaaccgytttcacgcaccgtaggcagaagtttccgccatgccatttcgctcacrctttcygcttcrtcaatccacgcaagyaaaatccgtgcttttgatttaatrctgtcaagattgtgccgtaaacckgtaaaaatataggaaattcgaccgcactttgtrcgtacatatttctcaccaacmtcaaaraaatctgccaaccacggttcactttgaatggcttgcttaatctcttctaatgaygartcttccaacgagttcataaactcacgaccgcataaaatcacaccgctttcgccttgcattgcccgttgataygcwacaaccgcagtcatcttggcaaaagtgcgtgtttttgccgaaccacgaccaccataagcaccacgataacgcacattctgctgtgtaaacaccggtatcagtttaggrggaagattaagctgtattttcatttggtgctaccaactcaataaccgtaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaactgcaaggattagatggaaaagcaagtaatgaattgatgtatgccattcgagatcatttgcgacttgaatataaatttgccagcggtttcattacagacagcaatgccattttattgggtgttacagcgagaactgtttggctttccgatgatacattaatcaaacaatttaatagccgtgaagggcaaaattttggtttagatgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcgttttacccttgaacaatcggcacaaaaagcgggcgtgtcctttaatacggctcgccgttggaagaccgaagcggaaaaggcaggcgatgactgggataaggtgcgagatgctcaggttatggctggcggtgagatggacgaactctctcaaagtttgctgacggggtttattttgcaataccgtgccacgatggaagagttaaaagacaatcctgaattatcatcaaaagagaaagtcgctttgctttctgtgttggcagacagctttaccaaaatgaccgctgcaagtaagcgaattttgcctgatgtgtcagagcttgcggttgcaatgaaaacggtagagcttttgggcgagtttattaaagaaaaacacccaaacttattcggcgattttctagatgtgctgggtgattttggcgaagtggtcgataaagcatttaggagaggtaaataatgtctgcattatgtttaatttgtgcctgtgttattgcttgccacgggcaaaatggctggggatggtttttgtttgcagctttgctctttgggggtaaatggtgaaaagtaaagaatttttgcaacagctttctgcgtatgcggaaagtatgcgagcgaaaatcgaagccgcttttgacgggtgggacgattcaccgcaggcggtggctgaacggcgtaaacaggtgtccgaccctgtaaatggcttggcattttttattaatcattattttccgcactatgttcgctccccgtctaaatctcaactacaccgttacctttttgagcgattaccgaaagtgtttgcgagtgagaaatcttgccttgaagcgattgctgctccccgtggtgaagcaaaatcaacgatagtcactcagctctctacactttggtgtttggtgacgcagaaaaaacgctacgccctattagtgatggactctatcgaccaagcctatcctatgctagaagcgattaaatcagagctggagtttaatcaacgtttacgcattgatttccctgaaattgcaggggctgggcgtgtttggcagtcggggacaatcattactcgggcaaatcagaaagtccaagtggcaggctcaggcaaaaaattgcgtggtttacgccacggggcttatcgtcctgatttggttattttggatgatattgagaatgacgaacaagttcgcaatcctgaacagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgggaagcctaccacgagaaattaactcagttcgtctataaaaccaacctctttatgaagccgattttcagccaagcaaaagcagagaaaaaacgtatcgtgcttgcagaaggggaagaggacaaagtattacacgcgacacaagaagtggtttctatgggcttggcatatccagtcttaattggacgtacggaaattattaaagccaaaatcaaaaaattggggctacatatcgttgcagggcaagattttgatgttattgataatgaacataacagccaacacgatgagttatggaaacgttattacagcataatgaaacgcaaagggattaccgaagcgatagctaaacgtgttgtaacctcaaatacaacagtcattgcttcattgctcgttgaaatgggttatgctgatggattagtgtgtggtttatttggtacatatagtcgccatttagaagctatccgtgacatcattggcgtaaaagaaagtgtgaaagtacccgctgcactaaacagtttagttttaccaacaggaaacgtttttattactgatacctatgttaatgctgatccaacggcggaagaactcgctgaaattaccttaatggcagcaagagaaattcgtcgttttggtattgaacctgcggtggcattgctttcacactctaattttggttcatcaaatcaactaggtgcaccaaaaatgcgtaaagtgttagaaattgtgagagagcgagatcctgccttgatgattgatggtgaaatgcacggcgatttagccttatcggaaaaattacgccgtgattatatgccagatagtccattaaaaggttcagcaaatttacttgtaatgccaaatatggaagcagctcgtatcagctataacctattaagagcaacgacaacagcaattactgtaggacctattttattaggtatgaataagtctgcacatattcttaaccctgtatcctctgttcgccgtatcatcaatatggtggcgttcgcggcagtgaaagcctagtaaaaatgaaatgagcgtgatttttcacgctcatttgcttcttattcctcaagtatttttctaaaattgtttttgatgattatggctgccttgtttttataatcgctttggattctttatccatgataacttcaattttatgatctacaaccacattcatattaatcgtaataccttcaggtggtgtttcaagttgtactttgggagtacaagcggtcaaatttaagcaaaaaattgtaaaaagtgagtatatagctttcattcttagaagggatttgatttattaggtttatcttatttaatcatcttttttctttaacaatgaaataatctctttcaaagcaatgatttcttcatttttctgagccaacatctcgtctttatgggcaatagtgagttttaatttttcgatttcggcggtaaggttttcaggctctccataatagttagtattattagcgtgttcattcattaaaaatagaacaccttttccttcactattcatcagttccaacacatcaatattaaaaatctgggcgatttgttcgagtttatgcaaattgagcttagtttccccacgttcaattttagcgtaaccattagtggacatattcattttttcagccatttcttcctgtgaccactgattcatttcacgcaccatacggattttctcatttacactcacaaatcgtccctctctttctttttccacccacaaattgagtagatttcccacacagtttgttgttagcagaatgtaaagcctacttttaaaatagctcgtattttacacatattttcgttaaataacacattaaaataaggactttctatgcgtttggcagttaaaacagcagcaatggcaattttggtttcactcggtgtaacggcttgtggttcgggcggtggtggcggaggctcatctacatcaacgaataatccagagcaagcaaaacaaatcgaagccttgaaaaaacaggtagaagcagagcaacaagcggtgaaatctgcgcaggataatgcaaaccaagcttctgaaaaagtaaaagcaagtgaagcagctaaagctaaggctgaagcggaattggcaaaagcnnnnnnnnnnnnnnnnnnnnnnnnnnnngcaacagcagcagaacaagccaaagctcaagcggctgcagataaagcggcaaaagatttagctgaagctcaagacaaaattgcgtcattggaagaggaattagctcccataagagctgaagcagaaagaaaacgcttagaagcggaagaagaagctaaaaaatgggcgtttttaacccaaagtggagaatggcgacatatagcaagaggtgatggtttaaaaggatatgctgaacatgcttatattgatggaaaggcatggtatctttacccaatcggagcatctgagagtttggtcttacaaaatgggattgattttaataaaaatacaatttccaaccatgtacagattttacctgtatatgcaagtcgccaatcaatttctggtgaaaaacaaacattccaagttgctaacgttcattttattaaccaagaatattctacgtatttaaattggtcttatcctgataatataagtgacgatgatttgagaagatcagcaggttatgtcgctttgccgacatctcaaaattcagaatatattaaaacccctgtaatcgcaacttatcaaggtaaagcattaggaatagaaaactataatgtagatacaaaaaatgtatatgaaggagaattttctttaattgcagattttaaaaatgaaagtgtaaaagggaatatagccaatctaaatggtaaaaattatgtcttggaaaagggaaatataaatatttcagatcaaggaaatcttattttctctggaaaagtagataataatctagattataaaggtgttttttctggaccaaatgctgaagaagtagttggcacnnnnnnnnnnnnnnnnnnnnnnnnnggcaaacgccaataattaatcgtaagggcggggattatccccgcctaaaatctaagctattgcagaaatgcctttatgttgtactaaagaaagcagtttcagtgcggcaccacttggttttttgacacctcgttcccattcggaaactaggttgctacttacatttaagtagtgagcaaagacagattgagaaaaattttctttctctcggatttctcgaatctcattgggagtgagcggtttaactggcgttaaacaacgtttgtcaaaactctgcattgttgttttatcaactaaaccaatgtcgtgtaaatcactcatcaattcgtggatcgctgcatttgccgggctgttgtattgtctcattagatacctctataaatgctttgccatcaagggctttgggtaaacgctgtttgataacacctgaacctaaatcggcatcaatcagaccattttcaatgtcgttaatggcatttcttaacgtgtcgtctgaaatacgttctttacgggcaaatttatcaaaatgtttagatttaaaaattcgcattaaatttataccactatcatctttagcgtgatagtaaaaaaatgaacagaaaaagtcaataaatctatcttatgaaaaaatatctcccccttaccctttttatccccctagtagcaaacgcaacccccgaattagaaatcaaatccgccgagcctacattaccaaaacaagcggttattttttcagaaaaatccgcaaatagtgaggaagtcactttaactaaagagcttattagtaagcctgaactgactcgtcaaatgttaaatcgggcgattgatagccgacaatttcatttattgcctgaactagtgcggatttaccaacaaacacctaatcccgatttgatactgatcgattatgccaacggcattattttggcaagtcagggggattataaaacggcaattgatctctatcgtggcattattgcgaagcaccctaattttcagcctgtgcgttttcgtttggcacaaatgttgtttgaagatcggcaaaatgaagccgcacttgcacaatttcgtaagctacaagcggacggattaccgccacagattgcaaatggggtggaacaatatattgccgctattcaaaaacgttcggattggtctttcgactttggcattaattatttgcacgaaagcaatgtcaataatgcttcaagctcgccttatgttcgagtggggaatgtaccatttaagaaaacggaagagtcgttaccgcaatcggcaaacgggctgagttatcatctcaatttagctaaaaattggaatgtcagcggctcccattatctgcattttgagaaccaatttagtggaaaatcctattgggataatcatcaatttgacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaatgcccgaagccgtccaaaccgaaatccgctcacgttttgcggtggcggtggtggaaagtaagccgaaaaaattacctgcggtgaaagccgatgtggatttggcgaacttgacgacaaaacagcgtgagattgctgatgctcgtatagggctgatccagtatgtgttggatttagagcaattaatgagccgaattaaagcggtcacttatgtttgcgaacttgcaaaaagtggcagattacctccgcatcttgctgtgttggttgaaacggctaacgctaaaaaatcggaaaaacgaacagtcagcgttcgtactttaaatggttgggttgtggattactgcaaggcgacaactgttgagcaacggttaaaactttttgccccgctcgtaaggcaggaagttaaggcagaagaaatttggtggctttcttggttgttgggaatttaccgtcagaagaatgcgttaagcgtacaagaaagttaccgctactttgaagcggagtgggttgaacggtatgccgacaatccgatgatgttagaggcaatgcctaatatcagcaaagtaagacgagcaatggcgaagttgccgatccatatcttggagaaaggtcgcttaagtggctcgaaatataagcagttattgccttatgtgatgcgtgattggtcgccatttgtggcaaatgatatctggattggtgatggtcactcgctgaaattaaaagttgcccaccctgtacacggcagaccgtttacacctgagctgacaatgattattgatggggcaagtcgaaaaattgtgggctggtcgctgtcgttgagtgaaaacgcttttgcggtgctagatgcgttacgacacggcattgcgacacacggtgtgccagcgatttattactctgataacggtggcggtgagaaaaataaaatacttgatgcagaagtcacagggattttacctcgtttctctattcaccacgcaacagggattgcaggtaatccgcaggggcgtgggattattgagcggttaaataagacggtgggtttacgaattgcagagcgatttgaaacttactacggcaaaaatgccgatcctgaagccactcgtaagatgttggctagacagttggcgtatgcgaatgcaaaaaatggcaaggaactgaccgctttgcagaagaaagctcgcagagagttgccaagttgggaagagttgaaggcagtcattcaagaagtgattgattggtacaacaatgaacacgttcacagtgaaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagacaattcagggtcatcaatggtttctcggtttaaagatattactcaccttgcagttgaacatatcaaagaattctttgtcgatgccgaagattttgatgatattgatttcagtcaacttgtttccgctaagttacttatacaaattaagaaaccgaccaaaaactcaccagatcagattaagaaagttttttcagcaatgttgaaacctgtgtctgatttagataatatctcattcaaaactcgtaatggtacatcggtaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattattttcttccgttctaaccaccgcaaactgtggcttaacgctttcatacacttttttcaggtaattatgattgctcaacggctcaaatttgccattctcacgacgattgcgacgcacctgctcaaccgtatcagccaacgcttttgccaaaacattagagcaagggtaaagctccaacaaaccttgcaaaatccgcaacgcacgcccattgctcaaactactttttgcaggtttaaacagccccaaatatgccaccgcaggacgaccacaaccagcagtcatttcggtgatcgttttaagtaactctcgcccagcatcatcttcaactaacgcctccagcgttaaatctgagtgacaaatcgggcaacgacacaatttcattttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatacactaagttatcttcatacttgcctgaatagctcgtcgaagtatttacaacaatacgctcgtagtcttggaacgcctgccagttatcccatttatcttcaatcatagcgtccacataacgcacaaactcgcttttggttgaactgaagaacacaaaaggcggtctggttagatgaattaaccgcaagaaatccactaaatcaaaataagttgcctgtttgtaacttgcctgatgagtgcaaagatatggtgggtctaacacaaacaacgctttcgggtcattttgatattttggcagtaacgtgtaaaaactttcgctaaccacttcaatatcgtctaaatatccgtccgcacttgagtaatccgattggcgaatgcaatgccaaaaatcttctttgaacagctcgtctagtgttgcaacttgctgaccactgaaacataaccacgaacataagatatgttcattgatatagccgtcaaagtttttaattacctcaatgatttgggcttttacgtcattcggtactttcttctgtttttcacaagcagcaagcaatggataaataagtcggcgtaagcggttaatatcatcaatatgtgccaatcgctctgcgtaaccatcgaagtcgttataaataaccgttgctttgggttttaaccgcttggttacgtggctaagcaaaccgctaccaccaaacacatctacaannnnnnnnnnnnnnnnnnnnnnnnnnnnnnnnnnnnnnnnnnnnnnaaaatgctgtaaaaacattcttttttgcccaataaatggtagcggagcctgtttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgagtgaccgacattgaaaaagtggtgtggttgagcgatgtggaattaagggatattcaacgtcctgaatttatccgcaaaacaaatagaggcttgattgagtggaacaatcataagtatttcagcttgaatttgttggattaccaaggggaagaagttgttatcggggtggatattcacgatccgatgtgggtgcaggtgcgaaccaaagacggacggtttatctgcaatgccgagtttgaggggaataaacgagatgcgtttccgcaatcctttgttgagcagaagcgtgaggagcgagctaaaggcagacttaaacggaaagagcaacaggtggcagaaattatggcagagcgtaatcctgttattacgattgaacaccagcaaagcgagttaataaccacaagttatcaaccaaaacgagaaaaagtgtctgttcgtcctatttttaccagtgtggtagagagggaggagtgggagaaaaaacaagcattaattgaagccgtaggctaaggggaaatgatgaaaaaaagtgaattattaaaacaatttcaacgtgaagaacaggtaaatgctgagcgtcaaaaggtgcgtgaggcaagacgtgcagagttaaaagcacctttaaataataaggtgacctgtttggttgagtttaatggagtggcttttgagctttttcttgaagttcgcaaacttgctccattaaaggcaaatacagatcgtccgctacttgagaaagtgtgtcaagcgtttgcgaatccacaccttccgcctcaagtagatccagttgcatatcaacaacatttgaaaaatcacttagggcttgctctgcaatctctggtgatagggttgctaattggcgaaatagagagtgaacaagctcagactgaataccttgtatcccagttagcaaaacgaggagtgaatgtagctctgatttagtgagtttattaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggttgagcataggagttatttgtagagccacgttgaatcttgttgggaaatagtagtaaatttattgtaaaaatacaaaggaaataacatgagaaaaatcaaactaccaaattcagatcttgcagacacatttaggaaagaagaaacttctgcattaaaagcagcaaaaaatatgctcttacaagagcaaaaaggagactttgataaagataaattgattgatgaaattattatgggaaggaatccacttttaactgcggataatatagcctctcgtctaggtattcctatagaagtttttcatcaatgggtaaaaaatgcagaccccaaatatcaaatccctacaaactcactatttggagagctcggcagggcaatgtttaactcatcgttagaacgaactgaacattacaaatttgctaaacctgatgtctatataggtagttaccctcgatggacaactgaaacattgagatcatggttacgagctaatttaaaatgaaaaaggcaggatagaaatcctgccttataggttatcgaaggtacgtaagctttaccctacgcccaccgggcaacttgccagatgtagctagattaataaagtattccgctattgtcaataattttttagaagatatgtcagtattacaacattttaatgcaatatccaaaagccgattagcgccctacagtgctctatgtaaaaatgcgtacccaggtgaattacaattctctctgtctaaacgcactatttgcatatatacagccttgcaacatcgtgcatctattttttcttcacttatccaagaaattgaaattagtgtaagaaatgaaatgacacaaataataaaacaaaatcttacgcagaataatgacttattaagtcatttctgttttcttgccattgataagacaacaaagttatctccatatagtcaaaatgaattaaaaagttgcctaatcaaactactaaataacactcttccacccaattattcggtacagcatctcaataacacaaactacgcttaccaaaggcttatacaacaaaatatatcagctgatgatattattgcaaatatgactttcggtttttgggtaaatctcataaataataacaaaagaaagaaccctaactatttgtattggaacaatatattttaccgaaagatatttaataatcgttttaataccattccgcagctctttaatgatttaagagatgttagagattttagaaataggctttcgcatcaagatgccgtttggagtaaaagtgcaagaaccccatctgaagcattaaaaaatatggagataacatataaacgatatgatttactattaagcaaattatctccatatcgacatcattttagaaaagtatctacttatctttcttggcaagagtcttttaattttgatactgatatttttaatgcagaaatcgacagcatgatgtcgaactcgtttatctaactcttttaaaccgcccaccgtggcggttttcttttatcccctaccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaactgcgtaatatgactggcgaatcaaacattactgaaacagtccaacgtgtcgttatggtagtttcactgatttgcttcgccatctggttggcagccgacttttatagtgggctttgggggaattggtcgttaaatcaattcatcattacgacattttttacctgattgtcttagtgattggggcatttgctgtcgttttagcgagcggttttataggtctgatcatcggtggactactcgaattactgaccacaatcacacgttataaaacccgagcatagcctgctttaacttgccttttcatctgttcaacccatttgggaatatcgactaaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtagtaacctttccatatacctaaatcttcgctatgcccttgggcataccagtttgcttttcttgactcaattaacgctcttgccaccccctcattacctgaaatatccaccttgattcgtggtttaatcttcgtaaaatcaatcatcaacaccgtaaaacctaacgcattgatatgcccaatcgccttttgtgtttggcgtaaatacttcaccgccatctgatttgctctattaattgtgtgtgccatctcacaccaccttttcttttcccaacttcacaacgatcacccgttgccctttatttcttcggtgatagctcggcgtggaccatttccgcaccgtttttgctgtcacccctaacttgattgctaactcttcggctgtaccgtcagccacattctcttcgccacgatacgccgcatagatctgacggtatctcatttgccacctaaccaatcaacatcttggtatactctttaatcaaccgttcatcaatttgacattcattgatatgacttaaacgcaccacaccacgaatcaacttgttcaaacgtctcgcattaccttgactatgtttaaaaaataactcgttatattcccctgtgttcaatgctctttctgtcaataaatgcaaatccttttcaggtaacgcattaccgagagaactcgttcgccaaatgcggttatacacttgagctaaatcgttatgcctgccttttaagttaattaacaaacgctcagtcccaaccaatgcaacacccactttagttgcatcgtggatacggcgaataaactccaacgagcgagtaggtaaattctccgcctcatcaatgataatgacccgttcactcccctttaaccttgccacaatcccatcaaacaactgatcaagcgtacctcggttgtttaaattcagtttttcactgattttctgcaacagcacttttgcggtgtagctcatattggtctcaattaaaattacccctgtattctctttcgcatactgcaacaccgcttgcgttttacccaaacctgacgcaccatacaccgcacacatatcaccctcaatgtgtgcctcttgaatagttgccataatctgacgagcagtaaaagtcggcacaaactccgcactcaccttatactcaagcaccttatcttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccttgctcatccagtaattttttaatttctgccaatgcggttgcagaatcaccaaacttttcaaccgcttgctttaaaagttcttctaaattcatttcgtttttctccatcaatgaatcacacgtgaaaataaaattgccatagctaatgccagtctcttgactgtccataactcgcacttctgcccccattcgccctttatctacaagggctaaatgattgcctcgtaaattccgttgaatgtaatcgtacttctgcccattccattccccagaacttcgctcatagctacaacgatagccaagcgataactcttttttgccgttttcgatcttacgagcgagattttctgaaaacgccttaatgtttccgtagagaacaccatctttaaaataaacatcttcccctactactccacttacccctttgcgttcagctggcgtaagtcccaactcttcactcccaagcatagtgtgttcatccacccaaggaacgagcttaaaactgtctattgcttcaggattactaagttcatcggctggacgatatacgggaatcaaatcatctgtatttgaggctcttgagccatcaggcaaaataatttgattgccccgataaagaaaaaccccctctttgctgagggggttgtctttcacttcgaaccaaccatttgtatcaacttcttttttatcttgtgctattgccatttacacaccctttgatataaagcatcaatccatttatcatccatgacgaaaacatttgcacaaagcctgtcaatcctttgagcttgtgatttagtaactttaatcatcttctacctcgaaatcgaaaactgcggacatagagcaaccacaattcggtaaatgccctggaagcccatataccttctgaccgtacatatcgccaatgtatggtggatcgtcaaacgagaatactttcccatttagctcttgatgtagctttctcggctctcgaccaccaccagaatgaacccatttaaatttcttgatgccaagacttttcatattctcagcttgaatatttaagtaagttttacgagtctgatcgattgccaccaagtgagcttttcttgcattacctttatacaatttttgcaaaaaaggctttaactcggcataacctttcccatcacttgaaatagagtgcattaagactttttgcacatcgcctaaatgtttttgcggaatcgttttaattaaacttaccgcttccattgtggctgcttgtgcaatatctttcactcgctcactcgtataatcttttttaatcgccaacccttgccctaattctctcaaactgagatttaaggtgcttttcgtattctttaaggtttgctcaaccatcttttccgttgatttcttcgcaatcaaattgaatattgggttgtacttattaagtaacgcattaaaaaagattctgagctgagaaattaaagagccacctttcggtagcccatcttgtccagcggaatcacttgcataggcgtgtccgtatttttcgtagatttcttcaaccccttttaatgcttctttgtgcattacagcaagagcttttacgacactttgagcatacttctctgaaatacctgcacttacaataaggggcttaccttcaattagcttctttgctttcgctgtctttgctttcattgaaatctacccctaactcttttaatgcttgcatttcatcatcagaaagccccaaaggattgttttcagaatcaacattaccaatatcgtgaaaaccagaatcagggtttttaactaacaccgttctcacttctgagccatcaacaacaccagacatcactaaagcactatacgtatctgccttagttttgttaatttccgccaattccttagccgttggactgtctgttggtcgccagttcactgtcaaatcaagcacttcaagcccactggatttcatcactaattgatggtgtcgctcgacaaattccgttaaatcgtgttcttgaattgactcaagctcttgattgtagttcttatcctcgttttcgcctgtactaaaccctttcggcgctgttcctaagagttttgtaactggcacattagaagcacctgaaaccgcctgatagttagtcataataacatcatcaagccctgatagcgttgtatcaaattgttgaaactgatcgccttctttatcacccagcttaataccgttattatcccgatatttaatccaagccattaggcgttctgtcgcttccgtttcatttgccataaaccgagcaagattcgtaagccaaacagatgtacgttttgaagtaaccaagtttaatgattcatccgtagtgcgttctgcactatacacacggctcataataagctgtggaacgggatagccaccatacatataaacaggcttgagcaaatcgggaagttttccatttcggaaaatatgcaaatgcgagcggtgatacttcttgccgttaataacccaataagtcggttcatagaaattccgtgcagcaggattatttaactcgccactcacaaagtaaggcatacaccagttaggatcgatttgtgaaatccctttatagctacctttagtcacaccatctaaattaaacggcttttcataaaactcaggatcgtcactatcaatttcaaaaagtgcaatcctcacaccaaaaacacgcccaagccctacaaattcctcacaatttttcttaatttggaattttttgtcatatctttgcaagatcttgactgtttcgtcaggaatatcgtccccgttcatcgaaacaatatcgtaaccgtttctggtagcgtctcttgctggtacaaaacacgctttatttattaaccattgctgacttaataccgcacacaatggaaaaccgataaaggattgactagcaaaccaatcaacaacagagctactcacaacttcagaagctcttaacgccatttttagccgagattcttcatcgccatcttgagcatcaccaccagctaaaatgttattgttggcttgctcaattttttgtagttgtcgttgatattcactaccctttttgtcttttgggaaatttgggtagctgtcttctgcttcttttatttcaaaaggttcttccgttttttttgtaaaaaatccaaacatatcactcacccaaaccaagattgtcgacctttcattaaaggctctaaagcgtatcgcagagcatctatataatgattattttcatctaaaaccacaggcaaaatatcaccacttagcctatctgttttatagctatacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaaaccgtgaagaaattggctactgcatatattgaaccaaacagccgtattcataccgatgaaaacagtgcttatgatgaattaattgtggattacgacttacagcgtgtgaaccatcaaaaagaatatcgtagcgatgaagggattaccaataaccttgcagaaagttactttagtcgctttaaacgtatgtactacggacaagttcataaaatgagtaatatttatctcgataattatgcgaacgaaatagcctatcgggaagatactcgcaaactggataatttaacgattttcaatgatatcactagcaaatgcctttctacaccatcagaaaacgcttggaaagggtactggcaaggtaatcacagacaagtagaaaggttaataatgtaatatggcagacccaatttactatacgcaaattaaacagaaaatcgctcagtttgaacgagaaaaagagcaagtattagcccatctcgaccttgttgaacgccgtattaagtggttagaacgagctttagaagcaatggaagttgatagcaaagagattcaacaattcgataccgagcattttcaatatcgagtttatcgcaaacaatttaacggtaaaataacgcaattgattcaaaaagtaatgaaagccgaacctgaacgatattggcgtgcgttagaattagcagaagcggttttaattgcagataaacaaccgaatacccctatatcaaaataccacaccaataatataggtaatgcaatgactcgattagtaaataaaggtgtcgtagaaagaatcgtagtgaaagaacataagattattcaatggaaatggatacaaaaatagcggcaaaatgtcgctattttaacgatttcaaccgccaatgaaaccctgcacgctcaacgagcctctcccacaatttgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccacgcctttagacgtggatttaacctcgtctttcttcgtcatcgtggttaatcctttttatttcaaaacattcaataaattagcaatggcattaattagctttggtgaaacaaacgctaaaataggtagtgttactgcaaggcttatttgccataaaccatattccataagtatctccttgatggttacggttaaaactgtcataatctccataaatcgttactcattcggctttaatgggtaatgaaaaaccccgatcatttgcagtgatcggggttttgttatatataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccactttttacagtgagctataagttctgttaagataaagtttccacacaataaaataacagaggtttacaatgattaaagcaagaatatcccgtcaacaaatcttaaataacattcctgagcagtatcgccattattttaatattgccatttcagatattgatcaagatttatatccactttttaaaaattttacagatgcggcaaacattctgtgtaaatttgctcatatcaacaaaaaaatagatattgttttctacacggaacttgagcctacactaaaaactaaaaccgcatctttaaatatagcgttaatcaataaagataccattcatttctatgtcggacaaaccatcttctacaatcttgataaagccattcaatatccaaacgaagttcaaatcactgcatatttagaagaacttgttcatgtatttatgaatgtcaatgatgaagttcttgtaaaagaaatagtatcttcaatgtatgaaggtgtgacttacaacaaagaaaaagatatatacaaatttaagtgaaacttgaagtttttattccacttgaggcaatatgctgaccgtggataatatctgaaacttcaatttcatctgatttaaatttcatcttcaaatcttcataaagtgccttgagcaaatacyctggcacttcttcgccattgattttgattttatcgcctaatgtaatttccattcctacycccaaacaaaaagccccgacygtttccgatcagggctryaaaatcatttcgctttctctcgcttrtacgagttgcaagcatagctgaaatgtactacttttctcgcacgaygtcaatcactttttgaacaattaaaattcacacgacttcacagataatcgttgttgattaatctgtggcaattttctttttgccgtttatcatcttcataaaacggcgtttttcttgccactctcttgaaagcaaatctctcaagcggtagttttctgcttttagttcctcaatttctgcttgtaattgctcaattagctcaacttgttgcttttgttttctgaagttaaacatttgataaccttgaatgaaaatctgaaaacttacaaataattcttgataaattattatttgtaaattataatatatttgttttcgcaatagggcggaaataagaagagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatggaggggttatgtgtgagtttgaaaatgtcgaagagtatttgcctgatagcgtcagagagattgtggcggtgattggattgcctgcaacggagaaatttgttaaagcctttgggggcttttcgtttcagttctcaaagtctgctaagtattttgataaattgcgtgaggtgttggggcaagaagatgcagtaaaactgcaaagttatatgcaagtgggtgaagtttatattcctcgctgtgaaacggcattgcggattttgcgaaatcaacagctttatgcagatttttgccatttaaccgaaacggacaagttaagtgggagaatggcgataatgcgactttgtcagaaatatcaaatttgtgatcgcactgcgtgggaggttgtacgatattatcaacgttataaatctgtatctcagtcagtcttgttttagtgtggaaagccttcccatactctctttactctcaattctttaaagtctctttaagtatcacttaaagaggctttttttatgacctttcctattagaaaaatcgtaatccattgttccgctactcgtaatggtaaaagtttaaagcaatcgggcaaatcatctgctgaagtgattgacagttggcataagcaacgaggctttaagcgactggcgggggcggtgaaaacctttaattctcaccttgaacaccttggttatcactttgtgattgatgtggacggaactgttgaaacgggtcgtcaggtcggtgaaatgggggcgcacgtcaaaggtcacaatcttcactctgtcgggatttgtgtggtgggcggtattacggcaagcggcaaaaatcacgctgaatttactgaagcacaatggcacgctctgcaccgtttactgcgtgagcttgaagcgaaatacccgaatgcgaagatttatgggcatcgggatttaagtcctgatcgtaatggtgatggcacgattgccccgaatgagtgggtgaaagattgcccttgctttgatgtgtgggcgtggttggatagtgaagaagttgtgaatgtggggcatttatttagataaatctccccctagccccctctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactcgcggtcgatttcactcacgttaccccaggtgaatgtgactaatttatattttggtaattctaaatttgcttttaaaacacgttcacgcaattcttttaacattcgaagcccccttctttcattttttgttcaatccaacggcgagcattgatgatctcagcaatcggctcttccgctttttctgtccacatttcaattaaaaatgccccacgatagttcaattctgcaagggttttgaagcaactgacaaaatccacgcaaccatcaccaaacggtacatcacggaattgacctttacaggtttcagtaactttgtaggtatcttttaagtgaatagccgagattttgtcgataccaagtttaagctcttccgcaacattgtcgttccaagcagaaagattacctaaatcagggtaaacggtaaaccacggtgatttgatgatctcgtcccattttttccaacgggaaatcgaactcataaatttagtatccataatttcaaccgcaatggtcacttggttacttgccgctaactcaaccgcccattctaagccttcttggaaacgttggattgtaccttcgtcttgttcttcataataaacatcgtagccggcaagttgaatggtgcgaataccgagatccaccgctaattgaattgccttttccataatttcgtaggctttttggcgagtcgcttcatcacgactaccaaatgggaaacggcgatgccctgataggcacattgatggaatggttacacctgtgttcactatcgctttgacaagttttaaacgctcttttttactccaatcaaggcgagcaaggcgttcatcagtttcatcaatggaaatttccacaaagtcaaaaccacaggttttggcgatagacagtctgtcttgccagctgatgttttttggcaaggctttttcatagatacctagtttatgttttctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatttctaagccaaaatcacttccaaccctttttctctaagttgtttaatgatttcaggatcagcttcagaacctgtaatcaaaatatcaattttgctcagttcactaaataacattcctactcgtttacctagctttatactatctagtagcacaacatatttctgagcttttgacgacatctgattttcagagtgggcgataatcatatcggttttatataaaccttctagcgtaaaacctttcccactcgtaaacataatatttgccgcatagctcatctcatttccactgatagacaatgtaatcgctttatttttattatattgtccgccaagaataaccacatcatcgtggttatgatcaatcaaatgatttgcaagcggtaaatagttagtaataatttgcaaacgctgaccacataacctgctacctagcatcgacattgtagaaccgcaagttaatacaacgctatccccttctttgcacaatttgctagcagcttcggcaatgcgttgcttttcatcattatttttaatttctctattcgatggaataaagcccacactgatggcttctgcaccattacggactttatgcaaacgcccttgctcacttaacttattaatatctcggcgtgctgttgcaggggaaatacctagtaattcaataatctcttgagttgaaagtgcttttctttccgttaaaagatcgagtaattgccgatgtctataattttcgttcattattcatctccttattttatgattattttaaaccaaataatgaacaatttcccccattttactggggggattgattaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcttgttttttaatcatattcctgatgtcgggaagatgtttttgcaaaaaattgggggaatgtgaccgcttgttgtgtgtgtttttggtgagttaatagtagtatgaagtagttaatagtagattttaggcaaaagaaaaccgccacaaatggcggtttaggtctgttcttctttcattactttctctgcgatgtcaaaaattaatttttgaatggtgaggaagttgataatgaagtaaattaagctaatcaaagaaaacaacaatgcgacagtttctggattgaatattattgtaagttcaatcgcagaaagcgtatggctatgaacaatctgacttattaagaaggtgattgttgctagtgagaaatacatcaaaaagctatttcttacatttgcgatgttttctttgacccgtttaaatatctgtggatttttaatggcacttggattaaaggtacaaacgatccccattccaatagaaaacataatgccagataatgtgtaaatggtgggcacaacagccttatacacaccttcttcgggtgtgtataaggaagatagaaccaatgcacctactaatgtagtaaggctaacgacaatccatttaatttttacctgcattttcaagttcttttataaaaagctccatttgttggaaaagtgtctgttcgtttagttttcccgtatctgtggtatctacttcgacctgttttgttctttgaagttcactgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaaaacaagctaaaaagcaaattagcgattggcagttggaagcctttgatttaactgtcactgtccccgaccataaaactgcaagcggtcagttatggcaagctgggcaacgagttcacgttatttgtgaagagtatgagatagatgcgattttctttttaatgggacggcgttttatgctttctagggcaggtggcacgcagacagagcttcgatttaaacaagatggcatttggacccctgatgcttataaagcaaaagctgaacaagctcgtaaacgtaaggggaaaaagggtaaaggacgaaaagaggaaaaagagctggtcggctcgtgggagttaggacaatgagaaagttagcacaacaggcaaaacaacgtattaacaatgctcaaaattcggtacgttctgcttttaggggggtgttaaatttagtgaaaagctcccctcaaattcaactttcacaggtatctggcttggcagacgaaacattgcaagatgttgagttgatgcaacattttggattgacttccgttccgccagcaggcactcaagcggttgttattccgcttggtgggaaaaccacacacggcattattgttgcgactgaaaatggctcttttcgggtaaaaggcttaaaaaatggtgaaacggcaatttatgatgccagtggctcaacgattattttaaaaaacggcagattaattgaagtggattgtgatgtttttaaggttaaatgtaaaagctacgaggtggacgcaacaagtggggcgagttttaaaacacctaaattagaaacagatcaggtctttactgctcaagggaaaattaatggcaatggtggtatgnnnnnnnnnnnnnnnnnnnnnnnnnnntttagcggtgatgttgtacagtcaggcggtagttttagtactgacggcgatgtaactgcgggtaacatatcccttaaaacccacacccatcaaaacgacggcagagggcaacctactgcgtaatttatataagcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgagtatgcaacttcgtggggtgtttctaatggggtgcattttaatgacagatggaatttttggggggggaaatgatggaaattaaatctttttcttttggaaaattaattgcggatttagctattgttggtggctttgtttattcgcacttgtatctcacggatagtgcagtagtaaatgtttatatttgggctttctgggcattttctattttaactttaatgtctgcgtttattaagcccactaagtttttgttcacggaaaacagagccaagcaaatgattataagtgagttaactattagcttggtcttggtttattttgggtatccagtattagctacggtcggttttatatcaactcttgcttatgctggctgtagaactgtaaagaacaacaagaaaacaggtaaacacaatgagtagttacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgtttgaatttgactatctctaaataggccgtatgtcagggcgaataaagattcgcccctcatatgattattcaatcacaatacgatctcggtttttttcaagtgtcgctttcccgatacctgaaacttcggtgagctgctcaacatttaaaaacttaccgtttttctcacgatattccacaattgcctgagcctttttcgctccaatacctactaacttatcttggatttctgaggctgtcgcagtattgatatttacaacattcgcatttactttttgtgtcgctgcgacttgttgcatcactactggtgtaggttctgttgacgtagttactttttcttcagcaaatgttgttgcagagaaaaacccaaataaaagactgaatgtgtaacgagaaagttttttcataaattactccttaaaggttggtttaaattgcacgcataccttacaaatcaaacaaacagcctgcaatgagtaaaaatgtgtttttcgacgcagatcgaaaaaattgaaaaatcttctagacaatactgctatttttttgttttagtaaaaagttagcaaaaatagcaagcttattgtgaaatttttctgaaaatccatcagaaatcctttagaataatacaatgtttccttaaacttaatcatttgggatactcaaaatgagccaacaaaatttacgtaaagaacctgtttttggtgagcctagcgcagtaaaaacagagaacgaaaattcggaaagcaaattaactctctcagcacataaacttactaagaaggttaatttttcattacattcaactaaatcgccaggacacacttttactccagtaatgaagcgtcctgtaggtggtactttttcttttgcctcaatggaagaacaaagaaatcaacaagcttcaaaagagcgtacattggagcaacaaaaaacatctgcatttatgttttctcctgttgtcaccacaacagaggagccattatctgaagcaccccaaaaggaaacagaaacaacaaatgccgagcaaccagcaatgactactcaaactatagagagaattctgcctagttctcaacctaattttcaaaaatcaatcgcagaaaaggtaccatttcaatctcgccgattacttcttgtggggacattggtattggcatcacttttgattcttttcttgttaaaaccaaatacaccagaaacactggaacaattggaacaagataatgctctacctattgaattccgcccagttgatgaagcagaagcgaagcgcgcagaagaagcaaaagcattaactgccccacaagctcaagtagagcaagcttccccgatatctccccccgtaaacaccgtagaaataatactgccattaacaacgggaggttcggcagtttcatctaacgttgaaaatgcttctattacgcctatttctgtaacaagtacagaaattacaaagcctactgaggaagtcgtaacaaaaccaacaagtagcgcaagtgtgagctatcagatggaagaagaaaaatcagaagtagagaaaattcaagctgagaaaactcaagtagaaaaaattaaaccagtttctgctgtaactcaaaaagcagaagtcaacatagaaaaagagcagcctgctaaaacaaaagtggtagtcgtaactgctaaacctgttgttacatcagcttcatctggctttatttcaagcaagacattaacgattccaaaaggtgtgtctttaatgcaggttttccgtgacaatcacctaaatatttcagatgtaaacgctatgagcaaagcaaacaaagcggtcagcaatctcaaagtcggagaaaaagtaactgttcgattagacaaaaatagccgtgttgttgaaatgagaataaatgctggaatttatactcgtcaatcaaatggtacttatatttttaaataataaatattgaggcaataatatcatcattgcctctctctatatttaaaaggagatatgagatgatatccataatagtgaggaagtattcttcaatatatgcaatgatagcattgctctctgcttgtatggtacctgctgtatcacctgtttctcaacttgaaaagtcattaataccaacaaaaaatacccaaatgattgttaaaattaatgaacgtatttattacgaatatctatgtgataataaacaaatcgttagggtacaatatgacaacacaaagaaaaatagagctgttgatattacttttcagcaaagtacccatacgctttattcaagtgtgacgaaaaaaggcaaaaaatacagcgatatccgctggatatggtcagaagattttgatggcaaaggcacattgcgagataaccgcaataaaatccttgccgaaaactgtgtgaagcaataggaagcataatgaatattttagttattgcaccttcttgggttggggatatgatgatgtcccacgccctttatcaacagctcaaaaccaactatccgaattgccaaattgacgtgatggcacccgactggtgtcgcccgttactttctcgtatgccagaagttcgcaaagcgatttcaatgccaatcggtcacggctcgtttgcgttatgtaagcggtacaatttaggcaaaaatttgcgaaatcaatacgatatggcaatcgttctgcctaattcattgaaatctgcttttattccgctgtttgctaaaattccccaacgtcgtggctggaaaggggaaatgcgttatggctttctcaacgatttacgcacgaataaaaacgactatccgatgatggtacaacgttatgtggcacttgcgtttgagcaaggtaaaatcccgacagcagaaaacttaccgattgcttatccttacctacaagtcgatagcgagaaaattgcacaaaccaaacaacattttgctaaacagtttgaatatgccgaaaaccgcgaagcgattggcttctgcccgggtgcagagtttgggcctgcgaaacgttatcctcattaccactacgcaacactggctcaaaaactgattgagcaaggctattccgtgcgtttatttggttcaaaaaaagatgaagaagccggggaacaaattcgcaatagtttgcctgaagccttacaacgctactgtatcaaccttgcaggacaaacggatttaaaccaagctgttgatttaattgctgattgcaaagccattgtcagcaacgactctggactaatgcacattgccgctgctcttaaccgaccgcttgttgcgctctatggtccaactagcccgcaatatacgccaccgctctctaaatctgcggtgattatccgcttgattgaaggtggtttaattaagatccgcaaaggagaagggcaagacggttatcaccaaagtttgatcgatattcagcctgaaatggtgttggacaagttaaataataagctgtcaaaaaaaagttcactttaattcttttcatagacgttttttattttatttctctagctatttagataaaataatcgtcgtttattaggtataatcgtttgaccttcggagttgcaatgaaaaatattttagtgataaagtcaagtattcttgcggataaatcaaaatctaatcaattggttgatcacttcaagtctcaaatttcagctaatattatagaacacaacttaggtgaaaatccgctcccgtattatgatataaatgctgtattagatatacgaggaaaatcacaagatgatactcaatataatgctctgactctttctaataatctgatcaatgaagtaaatcaatgcgatctcattgtatttgctgttcctatgtataatttaggtataccagcacagcttaagacatatctagactatttaacccgtatgggcgtaactttccgttatacagaaaatggtcatgaaggtttaattaaaggtaaaaaagctattgttgtgcttactcacggaggagtctatagggatacacctacagacttagccaaaatgtatatgcatgcagttcttaattttattggtatttttgacatcgagtttgtttacgcggaaggtcttggctatggagcagaaatttcagataaagctcttgaagcggctaaagttgaactggatcgtattgctcaaacattctaatttaatgataaatacaccgtctaattaggcggtgtttttatatgtaaccgtttgtcttttatccatatcaaataactacgcaatatttacaaataatcatttcaatcttactgcttttcagttagtttattactgtctatttgtttatcttaactataaggaaactcactatggaaactctctttcaagtagctcaaaattggttagatcaagatcctgatttagaaactcgtgcagagttagagcaattgatttcgcaagcaaaagcaaatgatgcgaaagctcaagctgaattatctagccgttttgatggacgtttacaatttggtactgcaggcttacgcggtcgcttacaagcaggttcaatgggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacttcacttgttgccttttctaatcgttcaaaagcgtgtttaaactcaaacccactcatttcagctttagcaaattgatgagccaacttttcaggataaagatcaaggttaggcttataagcacgtcgccctacgttataatcaaaaccactatctgtcgtcagcaccgtttcatcagccatttttaagcctatggtcttttgctttacacctttcttcggctcaatttcgacttcgtctaatagcttagaaccatctgaaaccactagctcttttcgctctaaatcacgctcttttagtgcattgacagtacaacgacaattaaagccatttggtgggtaaaatgtcgtccaaaatggatcgtcataacgaaaaattaatccgtgcatagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctataaatatgggattaacaacttggaaaaatgcaccggatggaaaaattttaaagagtgatgtcagtattgctaaaaattatttaagcgagcaacatattaaagagttagaacagttggtttcagcttatttagatttagcagagaatagagctactcgccaaattttaacatcaatggcagaatgggaaacttttttagatagcttcttaactttatcaaattatccgattttacgagataaaggaaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggttttgcggcaaacatcattacccccacagcaatcataattgcgattaccattacaggaatatcatctgccataccaactgcagtgataacggagtcgagagagaacacaatatctaaaaccgcgatttggataaggatcataaagtaattcgctttcttacttgtattgccttcagtatcgtgtgcttcgcccttaaccgcttcaatcagttccattgcacttttaaccacaaggaacaagcccccgaagaataaaatcaggtcacgtcctgaaatcggtttatccataatcgtaaagagcggatcgactaatcgcatcatccacgctaatgaaagcaagagaagaatacgagttgccatcgctaaacctaagccgataatacgcgctgactgacgttgtttttcaggtaaatgagaaactaaaatactgattaaaataatgttatcaatacctagcacgatttctaacgctgctaaggtaaagagagcaacccacgcttctgggctggcaatccactcaaacatagaaagatccttgataaaattagacataacatcggcaaaaattgccgaactaaaagttgcacatcatatagagagctgtggcaaaattaaaggggcgaatgcaaaaaattttgtaaaatctctgcggtaaatggtttacgcaaataaaaccctagtggtagtgattgaattttttcaccatattgatttacagcccctgctaacgccttattatttcgcccttttggacgcaaatgaagcacttcccctaaactcgcattgatctcatttaaacgtccaagcacaatcagttccattaactcttcccagtcttgttgtaactgctgttcttgttgttgggacggcgaccataaaatcggctgtccgatatgccttttttcaaggggaattgaccgcttaccttcgactgggatccacaaaacccgttgcaatttatgtttaacatgtgacgtttgccatacaataccgtgattatccgttaaaggcgcaaggctgacaaaggtagtttctaacggcaatcctttttcattgacaggaatggttttcaactcaatgcctaaatgggcaaaatcttgttcaggcttactgccagcctttgcccctaacgccgtttcaataagcatacccacccaacctttatctcgacgtaaatcaggcggtacaaccatattcaacagttcggcaatttcccctagggtaaagcctgcgagccattgagctttggcgagaagctctgtttctgtggtggaatgggtggcaagttgcattgaagtgcgatctcttatgcgaaaataagcggtcacttgatcataaaaatttgcaaattttttatctgaaccgaccgctagttattcaaatataatgcttttcattttaccatattttactaacaatattttcattgagaactcttagtatttaagttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttacaaaggctcgaatgccaaagacttattccttattgcagaaatatgcagagcaagacaaaaaacgtgttgttataggaaatggtgtttcaattagattgagctaattcaaaaacaaggaggaagctatgtaaccactaataaaccattcacaccgccccactcaatctttatcggcagagcctaaataaaattgtaaatgcacttggggcggtggctgagagaatagagataagcgtcagcgtttatctctgttttcttagggaggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgtacggtaactgagcttttgcaggggcgtagtttaaaagatttggatgtgttttctccaccatcatttaataatgatgatgtggcagattatgcgaatttggaaactcattttattgattcaagtggtcagatttcatgggatctttttaaatcagaaccagattataaatttactcactgggatttttcaggcacaacagagcaggaatttgctaatttgatggaaattttcagccagtataaacaagaggtttatattatggactatgaacatttaggtgtatacgcttgccgtataattgctcctggaatgtctaatatttatcctcctgacgatttgatctatgcgaataataatatgggaatggaatggcgtgaaatgttgcttgatttaccctatttccatcatgagaaagaaatttatcaagagctattggatgagctggatgagcaaggtattgatgatatgacacgggtacgtgaatttattggagtggtagctgaaaaaggaagcgcactacaaactttacgtattggtgaattaaaatctatgcttcatttggctttagggaatcttgaagaggcattagattgggcaacttggacagttaatatgaatgcttctgtattttcagcagaaagaaacaattactatcgttgtttaattagtgtaattgaattatttttggatgaggatagggaacctgagcagtatagaatgatatttaacagaatgtatgggaaagatgctgtagattttgtttggaatataatgcagggagaaaatccgttccatggtttaattggttctgatgaaactttgaggaatatgtcagctcatcaaaaattactagatgcataccataagctacaaaaagtaaaataatagaaattacattgataaatgtagtgtgataaaaacgcctatgaatagattctatttataggcgtttgactttctatttcattctagtatctaaggatgatgttgggataaatttagtatcctatctttcatacaatgagctatttctgttaaatatttttcttaaaaagaggaaaatatctttattgaggacttaaattgcaaaaccaaaggcatagaatgcaactaatgcaatagcaatagctactgtaccaacgttcaatttgttaaattcgcctgaaatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaccacaaaaaagccccgaataaatcagggctatgcaaaaaattttgtaaatatcaggttcttcgcccattccgatgggcattcactgctaacatctgcacaattttaaaaatctgctctgtcgtacaccattgcaaacgctcaataccaaacgaccgcttacaaatagcgtgaacataatgccaagacttaccactactagcgataaaggcttcaatctttctaatataaccttgacgcacctcatctgcgttgctggctgtcgggcgtttaccatattttttcgatttaaccttaaaccctttagcacgcataccttgcaacactatcatcaactcagggtcagtcatcatcgaacagctaggtttatctaccaactccattaaaaagagcttataggcttcatcgctcatcttcagctcagttttgccgatatggattttctgtatcatctgcttacgagtttgtgcgtacattctctttctcctgttgccactgtttccaatctgcaaagccgtgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtcccattagactcaaaccaacaatgcaacccagcagaattagcacaacgcataattgcttcccacgctgtttcgctaatatcaatatcaattttatccagagtaggattattttctgctcgtagctcaacctgtttaatacccaacggctctacaatttttttgattgcatcaaatattgttaagcctttcacattcgtaataggagcggagcaatccaataaaattgaagccctatctcgcccattgatggcataataacgcccactcttactgatccgatgttgcgtattatcaacaatacctgttaagactgtttcaccattaattttgactacggcggttttacctgcaaaattcggcaatacctgcatttcactggatttgcctaaatcaaatgaaaagctatccgcaggaattaaaaaatcactatcaatattgtagcttttccaatttttatgttgcttaccatcaatctcgaccacaatctcattttcaatcatcgccttactccgaataacaatttaataaggtgcccgcctcaatccaatttggctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctgtactgtcagtagtatttgtactcgttgctgttatactttttggtgtgataaatttaaccaaatcaattgtagcaatgacagcccaactgccttgatagtttgaggtattaaaattaactttattttgattcactaaactaaccataaatttagtaaaatcattagtaattaatactgcacctttctcatatccaccaattttctctgcaaaagaagcatcgaacagatattttccacctttgttttggtaaacgatatgctccgtaatatctcttaatataccgttcatatctttaccagatggtgcttttcccccttgtgtgattggggtcattgtgatctgaggaaaaccttcctcgtatgtagcagcactttgtgccaaatctctagttctagtttcaggaatatccgttttaagtcctaaactagcccaaatttttgataataattttggttgtgccatatttactccaataaaaaagcctgtgaaataaattcacaggcttgtattactcattaattaatctatctatcgcctatataaaaagcaccttgcccaaaaggcgccatacctgcttcattaaaaccaaatgcattccttatatctggttcatagaaatcaactaaaacacctgtaggtctaggtaataaatccgtacttataatgacagctttttcaataggtgtaagattaaaatcaaacacatatctcgccatcattgtcccattcttaatgaaataagcccttcctctcttttcaaaaagactggacactaatttatttatatggggagctgttgcataaatagtattactcattgctttgaaaaatatcattgctctatacatttcatcattcattagatgtcgagtaccaacagcaaaatcctttaaatcttctgttgctaaagttgagctaacaaactgatttttctcatcaacttgtatatttctatttatgccaacgatttttccccaaatatcaagtcctatacctctagctgtatcaagattccaaattaaattataaaatccctctatatcaactctcggatctagattttcattaatattcttcagcagactagttatgatcggactatttgcatattggctaataattgttttttctagctgtatcatataaacaccacactaatatttgactccgtgagtgttggatattgatctattcccaattcgattgaatccgcatatacagatttgcttttccctatttttatatccagcaggtgatctttaggtaaagcattaacaacatcagaaacaaattcaatggcgtaaagcgttgagccaattttcctacgattttgcttatcgaaagtattttttattgtagatttgactagttccgcacttcctataactgaacctgttcgcaacttcacttgaaaataaataggggtcaaattgggtcgcataaattttatctcatacactggtctaggaactgtataactatcatcttctacattcactgttgtgtcaccagtaaaatcacacccatttccagcatatctccatatagtttttgctatttcctgatcatttccacctaataccgcaacataaacactatgaggctttaacactttatttgttattcctattcttgtttctgtgcttttaggattatcaataacataacaatcaacaacaccatctaatgaagccacattagaataaacagaggcaggcattcctaaagaatttttcgctacactttttttataacgttctgcaaattccgaaccactttctttttctgttcctgtaatagcagggctatgattatcaactctatccaatcctaagattgactgatgaattttatttacactattagcagcagctgaatatataccttttgctgtaagatttccgacaacttgaccagaactcaatatactgatctcttgatctaatacccagtcattattattttcgtctttaacaataaatccctttggaatcgttattcctggaagtccataaaaagtacattcaactgttgagttaatctgccctttccgcttaataaaatagagtttacctatcgcatcttgcataaacccttccgaataatcagggtccaggttatttaccaaccaagcaatttgattatttttatctgcaataatcgctgcgatagagcttgccaactgtccttgtggagtttctaaatttttattaaggtttccgccaaatgcgtcattaaaatccgctaaaacaccgtttaagatttcttgctcggttggcagaattagcccttgaggcgtaaattgtatgtttgggacatttgtcataaattaacctctacttttcttcctttatcatcagtgaacttgatcgcccctgttattgttctatccacattgctttgaataatggcttttgccgaaacaacttcaggtacagataatgctgctttctctaagcgatattgatacaacgcaagagattgtttcttgcctaacgtttcctcaaaataagggataccttttgccttatcatagtaaagctcacctttaaagagcttaatggcactcgcaacatcttgagcctttgcataagggtcttttgtataagctatattcccttcatcatctaacattaaatcccatctttcagggtgtaaaaagagtgtatccattacttatacctttacatctggggctggtccgccgttgtgagtgtgattattgtgagattgacgcatactagacatcgatttaccgccagatttagcgttatcagtaatatctccacctgcggttattgttgtctcaacttttagcgagtttgttgtttcaactggtgcatcaagtttgatttttgagcctttgatataaacttcgcctgtcgcaaccacatcaattcctgaatctttgaagaagatgtattgctcaggcacgccatttaaaaatccaccaaaatataagccgtccgcataatcaaacttacgcaaactttgcggcgttgatggtgctttattggcttttactgaggaaatatctcgactacaaaacccacacataccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtatagctacaaaaccgaccgcttgtctggcgatgtgttgccaacattagttgatgcccataaccactatattgatgcgttgcggtatgcgcttaatcctcgtattcagcggaaaggggattttagccaaaatccacttaaactttactaaggataatttatgtctgatgtttctattgttatgcgtgaaatcagggcgttgaatgaaaaaggtgtaatgattgatgatttgcttggcggaacaaaaacaatgcgacaagcagggaaaaaatacctttatcaattcagtcttgaggaagaagaggcttataaaaacagacttaaccgctcaacgctttatcctgctttatcggaaacgctctaccaaatgacaggtagagttttttttgagccgattacgacaaataacgttcacgataaattaaagcaagatattttgcctgatgtggatttagagggaaataatgtcgatgtgttttcttctcgttggtttaatgcaggtttaacttatggcgtggcgtggtgcttagtggattacacccgtactgagaatattcgtaccattgctgatgagaaagcggctaatgctcgtccttattttattttgattaagcctaaaaatgttttgggatttaaaacggataaaatcaaaggaaaacgacaaatcacgcagtttcgctatatggaagatgttgcggtagatgatggcgaatttggcacgaagattgagaagattatttatgtgtatgaaatcggccgtatgcgtaagtataaagcggcagaggggcaatggacgctgattgatgatgtgcaacttcttgctcaaaatcgaccgcttgaagtggtgcctgttgtgccgtttattacgaaagaaagnnnngtgtttgcattaggtgagccgccgttgcttgaattagcctatttgaatattaagcactggcaatcacaatccgatcaggacaacattttaaataccgctcgtgtgccgttattagggattttctccgatactgaagtcaataagctacaagttggtggcagtgcgttacatttacctgcaggttctcaggttgcttatatcgaacattcaggtaatgcgattaacgcagggcaagagagtttgaaagagttggaaagccaaatgcgtgttgccggggcgaaactcttagataaaacggtgttagcgatgaccgacagccaagctaaagatgagcagagtaaagaaatcagtttattgcgattgtatgcgaataagtttgaagatgcgttagatttagcgttggaatacgttggattatggttaggtattgatgatgttggtaaggtagagattagcggtaatattgatgacgatctcgatccaaatgcctcaatggatatggtcattaaaatgcaacaagcaggcacactttcaaaacaaaccgtctttaatgaggcgaaacgtcgtgggctgattagtgataatgtggaatgggaagatgaacaggctcgcttaaatgaagaaggggtagattatggccttgagttcgcaggacaaaccgaaacaaagcctgaatagtcgtattgcatacgcattaactgatcgcaaaattctgcattttcgttatgatgcacatcttagacagcaggtaatgaaacagctgagtaaaacacaacgtgagttgctcaatcgtttagcagccgcaggtgtggatgctttacctaaaaagcaattagacacactgcttaaggagcttaagcaagaagtggcaaaagtctatcaagaaatgaccgcttacacgcaagacgagttaagcggttttttcacggcggaaacccaacatattcatcagctttacaatgatgaagtcggctttgatttttttaatcaagtgcctgaatataagcaaaaagcgaataaaaccgcaacgattattgcaggttcacctttagaagactggtgggcaaagcaaggcaatgattttgcctttaagtttgagggaattattcgccaagggttgttagatggtcaacaaacaagtcaaatgattaccgatgttaagcatttgatgaatacgtctcgtagacacgctgaaaccttagtcattactgcagtggctaaagtggcagataaagctcatcaagccttaagagatgaaaaccttgatattttggcaggagaaaaacacctttctacattagacactcgaacatcaaccgtatgtcaattaagagatgggttaatgtgggatttagataaaaagccgatagaccacgatgtaccttatcaacgaccgcctttgcacccacgttgccgcagtattttacagcttgtaaccaagagctggaaagagcttgggattgatgcagaagaaatgccgtcaagcacgagagcaagtcaagacggccctgtatcagagcaaattaactacgaaaattggttgaaaagcaaatcgcctgagcaacaagatcaggtattaggcaaaggtaaggcggatttatggcgtagaggtgtaattacttttgcggatatgttggatcagagcggtagaccgttgacgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctactaacctagcctaagtgctaggtttttttatacctaaatttcaactaaaccgcttatacagcaatgtgtaagcggttttttattgcctgtaagatagaaaagtacactcgacaagtagcgttagtctggcacgcacaattcgagcgattacagcgcaatgaggttctttcgcaaggtattcgtgttatacgaataccttcaaatggtggtgaacaagaagcggtttgtttaccattgcactatctcaatgggtggctatttggggtcaaagtttccaaagttaagccagaattaaaagagaaacttattcgttatcaaaaagaatgttacgaagtgctttgggattactggactacgggcgtagcgaagtgggatgaaattcgacaacggcgagaagttctagaagaaaatgaaaacgcatcaaaaaaacgcgcaagcgaagcaggacgagcattacaaaaacgaaaattagaaaagcatacttatgaaattggtatagcacggctagatagaatggaacagttattacttgatatttaaggtgtgattataacgatcgcaccttttttattacatgaaaattaaccgcactttcgcaagatcgtgcggtttttattatccacgtttcggaagaaacacaaacttacttaggaaggaaatccaaatgaaattaaaacttgatgaaaaaggcaatgttgtggttgtagatggtaaacctgtgtatatccacgatgacgggaaggaaatcccttttgatgcaccgcaagcaatgcagaaaatttcttcgctcaatgctgaaaacaaacaacaccgtgaggctaaagagaaagcggaagcagaactcaaaaagtttgacgggattgatgatgtagcaaaagcaaaagaagccttaaaaacggtggaaaaccttgacgctaaaaaactgattgatgcaggtgaagcggaaaaggttaaacaagaagtgattaagggttatgagcaaaagctggcagatgctaaagcgttagcagagaaagtacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaggaattagagtgtggtgggaagcgaaagtttaggagttaagaaaatggcaaaacaacccacaaaacccgagtaaaacaaccagcaaaactgcgttttattactgaagagcaagtgcaaagtgcgattaaagagatcggggatttaagtcgtgaacatacccgtttaacgacggagatgaacgacattatcgcagaaaccagtgagcgttacgcccctgagttgaaacgtttacaggcagagattgagccgttacagcaagcggtgcaggaatactgcgaagcacaccgtgatgaattgacagaaaacggcaagagtaaaaccgctaactttgtgacaggcgaagtgcaatggcgacaacgaccgccgtcggtggcaattcgtggggcagatgcggtgcttgagtttatgcaacgtatgggctttgaccgctttattcgcactaaaaacgaaatcaacaaagaagccctacttcttgagcctgaagtggcaaaagggattgctggggtgacgattaagcaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatcaactaatttcttcgtagcgtggacttctttctgcaaggcatcaattcgctcattttgcgaatcaatcttctcatttgcagacgtaaccgcctctaaaatcaggtctaatttttccgaatctgtctgtttttgctttctacgactcattgcttgtctgcctttttatctaatttttgattaacttcttttagcccttccaaaatatcatctagcttctctcttaagcccttattgacttcttgagccagctcctttgattgatatttctgctcaatttcttgcttcaactctttaacgctttgctcattgcggttaatgcggtcaaaaatcaccttggcactaaaagcaacaaggggagcaaccacaaaagagaccaacatctgaaacagcttctcatcaatcataacgcccccgttttgctcgaccgacaggggattgattgccttgtttgactgccatttttaacaaatcacgacgagttgccacagctggcttctgttttctaaaaacacgctcacgccaccagctacggagctttttgaatagtcttaccatgacaaatctcctcataggtcagattgtgtgccagcacttgacgcttcgtctccgtcgtatcctgacgactggggtaaatcagcccgaacgccgtgcaacctgtcgtcgtcacggaagtaaccgtgggcgtgcaactgctgatcaacagcggaagcattgctacgcttaacatcatcgtgatttttctgcttaatttgtgcatttttgatctccgttttttgagcctgaattttgctcgcttgttgttgattttctgcttgtaacttccgattacgctcttcagccttttcaacttttaaccaaagccaaaacaaagcacaggacgcaataaataaaacaagagtaactatttttacagtcatcattcgctttctccttggcgtttaccgcctattgcattagcaaagccttttgtcgccacgccaccaccgcaaaataaagcaaataccgtaaacagctccgcaacattggcacggtctaaataaaccgaataagccaaaatcccagccattaaaatcgcaccaaaaaactggataaacgccgtcgtagataagcgtccgttatcgtttgtgattaattctttaaatttcatttttattcctctatatcattccccctctttgacaaagagggggctagggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatagctccagtgaaaatttatgaaggctaccgctaaacttctcagggtttgggcggtaacgtgtaacgggctgagaaactgcgactaatggaacacagcaaagggcgaaacctttcccattacacgctaccatagatagacgctctaggcgttctttgggtgtgcgtgtgctacgaataaaaaaacacgctcggggcgtgctattcgccattagtaaatcgttcgagttctcaggctcggttgtagattttgctacaacgtgggcaggataaacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccacatttgacaacgcccacgcaagcacaggatcgccattgtgttctatcatttgtctattgatcagcacttccgccgacttcgccacggggctgtaacgttggtaggtctgtgggaatggttcaacctctaagccgtagccttgtagctgtgtgcgtagatgtgtggcgttccatacatcaaaccctatcattttgatttcaaactttcctgcatcgttaaaaatatcatctcgaattttgtcatagtcgatacagtcaccttttgtcactcgtaaccagcctaaacgctgccattgttgatagatagcccgatttttattagccacgttctgcagttgatattcgggaatgtagtgccgtgtaagtagccttactttgttgttttcagtcgggaaaatgtaacaaaggctggtaatatcattcgtagaagataaatcaagccccatatagcacgccttaccgtgtaagctttcttcttcatagcttcgtccgcacgctttccagttgccttcgcctagccacggtgtagagccgttgcaccacacattaaagcgcttagtaagcatttccacccattcggacggaataccacgagcttttgtgatggtgttctcaaaatctttataggggattgatttgcctatattggggtttgctttgatccattgtgtcgggtcgtctacttcgctttcatcgtccagttcgtaaatcagaatgaagatactttcgtttttttctgtgccgtctaagatttggcaacagtaatcataatgctgtttacacgctgaaatggtgttactgcctgcggttgtaatcgcaaataaaagcccttcgggtcttgccccttgtcctaattccagtgcactatatacgctgttatcggcgtgtaggtgatattcatcgacaatcgcaaggcttgggtttgtgccttcaatggttgatgatttactcgcaagcggtcgcattaagctgtttttttgcagaaatagcattttgtgctgttgaatggttaatcgcttgcttagtggtttggataacattgccattttctttgcatcatcaaacacaatgcgggcttgatctcggctgacggcggcggtgtaaatgtcttgttgtcctttttccatcactaagaaccaattcgccagtattgcccctatggtagatttcgcattttttcgggctacctgcacgtaagcagagcgatattttcttaatccgctatcacgatatttaaagccgagtagattcgcaaagagaaagatttgccagtctgaaagctctatcggttgtccgtataggtgtcctttaacgtgtgggcataaattagaaaacttgataaatttctctactgtttcgctatcaaaacagtagatagggtttgctaaatcagcaaaatagcgatctacggcttgcttgatacgcttacacgccacgatttcgccatttttaaccgctaaagcgtagttattccattcactcataagctatttacatcgttaaaatttcgttgatttcgtctgtttcttcggtgtctattgggtttttttcgtctgcttacaggatcaaaaccaagcaaagaagacattttaatgatgattttttccgcttcgctttttgcagtaagtgcggggttgcgtgcttctgtgccttggctgtttgtaatgctgaagccatgttctgcaatatcttgaacggctttgcggtaaaggctgtaattcacgcaataaagttctaggttggtgtaatcttcgctagtaatatcaccacgttccgccaacactttaatttttaatttccattgctctctagcaatctcatctaaataacttggggcttttggggtttttgttgtcatttgctattctcctttagttccctactttttcgggaattaaatccctattatttcgggaatgcctatattttctaaaaaattgtcgtgcgtaaaaattgagtggggggcggttcttagcggttgggcttttctttcaaaaactccccccacctgttcaatttctttataactcattgattttaaagcaaagctcaaaattgaggagatgtttcagttatggtcatatgaccacaactaagtaggtattcgtataacacgaatcccttacaacacatcattacgctgtaatccgttgtaggtgtggtgctttgccctataccttttacttcttcgctccatatccacgcttatctatcactcttgtcttgtagctatggcaatcacgacataatgcttggtggttgctcattacccaaaagagcggatcagcttgcccattctgtacgggcttgatatggtcgattactgtcgctggtgtgtagcttcctttcgctaagcacatcacgcataaagggttatgctttaagtattcggctctgtacttggtccatctatgatcgtaaccacgtttgcttgcgggcaatctattatcttgcttcttctgttgatgttcttcacatctgccagccttcacacgattacgacaaccagggaaagagcaacgctttaaaggttgcattggcattatgtaccaccgttaatagattgcgggttctctgtatggatttcataatgccttaatagcgaatgggacttcatacagttgaacatcgctcacggtttcacggttcgcatatagatgcccgataaacattaaacaaccaaccttaatgccattcgtaaactgtaccgtttcggctgtggttgattctccccacgttttgccgatatggttctgtgctacttctagggccgtgtccgcatataaggttagtagttcatcatcaagatcgtgctctatgcgtaaatgggctttgatttcatctaaatctatttcaggtttaaccattgtgagcttctccttccttacacattaattgcagttcttgatgttgctctttgctgtcgataacattttcaattttaaaaattcggtttccgtacttaacccgcatttttctggttacttcaagatcaggctgataacgcattcttatccgtacaacggtatcacccatctgaaaaacgccactgaaatattctcgcccttgaataggctcgatacttgcccgtagggttttaatatcttcccattcgttttttaaaacagagccattacgaataattttcccttgttcattgggtttcggtttggcgatttgctgcagtgtgattaccttgtcataagtgccagccttaaccattcttgccatcttcaccgccttttttaacttctactgtttgcttccacgcttgactaaattcatcaccgccaacataaggaagtaacccctcacgcttacgggcttcatttgggctaagaatgccgcatttgattgcggtgtcataactcgcaaagcgttcatcaaggcatcttttaactgctgttcaaaattgactaaatgcggtcttaaggtttgccccaaaaatgctcggctggcttcgctgaaattcgcataacttgaatgcgaatagtcctgtaagaaaatcgggctaatgttgaaaatgcgggcaatatcttcaatagtgaattttctactgcccaaccattccgcatcttgattactcatccctagctgtttgtaatccattccaccttcaagcagtggagtcttgcccgcattcttcgcaccttgatagcgttttaaggcttctaaggctttttgccctttggtttgatctaaccattcggatgttgtgacaataccgcccgccattaagccatttttcattaccgccgatccgtgtcgctgttgggctaaccctaaaccgacggcttcacgacaaacggtaataggtgaacgccccataaagccatcatttgaagcgtgtcgcaaatgtaaaatttcatcttgaaagtagttttttactttgccgtttaggtcggtgatttggtaaagataatcgccttttagtgttcgctgaacattgacggaatagggtgggtatggcgttaatgtttcaggctgtcctttgctattccaaccaatcaccgcatacgcattaccatttaaaagcaagtggcgcatcatcacttctttaagctggtatggggtttggttacggtttggcatttcattaagcagatactcaacactatgattttctatgcgtttccgtccatctgttgttacttcaaacaaataacaaggcatagatgctaccgcttgagcgattacatttaccgcatttaatacagcgggcaacgcttctgcagtatgtgggctaacaaattcccccgcacctgtgttagttgctcccattgttgccatcacttcatcaatagataggctgcgggtttcaggctcttgcttcttcttgaaaaatccgaacatctacgcccccaataccgccaaccatttacgacggttttcatcttgccaatgtgtaaacttttcgccttttgctaccgcttgagagcgtttcaaaatctcaagacttgaatcagggtaagcgggaatgcttgttacagtcacttccaccagttccgcttgttgtacggttcttaaattcggctctacactaaaatcccactcattttttactgttctgaaaccaaaagacattccgctaatatcgccacgttctacactaactaataaatcacgccctagttgtgtgtcgggtggaatcagctcaaaacgtaaccccgttgcatcttctgtaagtgttaatgttccgcttgatgttctgcctaatagttttgcgtggtcgtgctcaaacaacgcccgcacatcttttccactttttaggctgtctgaaaaagcattcggggcgaatcgttctacatactcaccccataacacttcactttctttattccactgcaccacataacccactaattttttattttcgccatcggttgaaagggttgtggatctaatttctaaatctttcattattgccaccataaagacaaaaaggggctattacgcccctgttatggattaagatgctttcgcttctaacactttgatagcgtttgaatctaccacgccaccgccaagatatttatctgtgtggattttatagaagcccggttctgtgattgcatcaggttttgtgcgtgtgcctgtttcgtgatcgacaatcgtatagccacgtttaaaatcacccaccgctaagaatggatttgtgccttgcgcatttggcattgtttccacatagtaaacaggtaaaccaagaagagtagatggagcacccacttgtaaaccatcacgccaaatataatcaccattgccatttttgagcttctgtaaagtgcctgctgtttgtgagttcatcacccataccgcatttttacggtatttgctatgcaatgaataaagcagatcgattaatgcatctgcatttaatttagatggaactacttccattttttgcagtgtaccgaatgggcgggtcttatcgtttgctgtggtgcgagggtaagctaagaagccttttgcctgttttgtacctgtaccgttggttaaatccgtttcttcggtttctgcaaaagattctgtgatttcatcagtgagccagctaagaatatctacgctgccaaaatctaaaatttcttgcgtggtttttggatatgcatagatgtattgaacgcatttctgtttcaatctgtgctttttgctggcgtaactctaataattttttgaacataattattcatctcctaaattggatttgtttagttgttgaaatttatactgaatacggaaggttaaagctgaacttacccacacattattttcagtgtcgtattcataatcgtaagactgattaaaatcagcagttagagaaaagtttttaaagtctttgaatagaatggcatcattaattttttcgttaatttcatctagcttttcttccccttgataaaaaggtaagtaggtcagaatgattaaatctgcagtccattcagaatgcccaatagtaacgggttcacctgaagcatcatttaagtacactgcaactaaaggcaattcgttatcagtgtcgataatcttcggtaaaccgttatgaaagtaataaatttcctgtaaatgctctgtcagaaaatcaattacttcttttctaatttgattgtgaattttcataaaaaccctcttaattaagacggcttacaataagcccataacacaatatataggctaataactcgttgtaaagtaagggaatttttatagttaggatacgaaaataaacgatagctaaatttacaaaactctaggaaaggttaattttgagaaaatttttaatcactagatttagtcacttagtcacttaattatcactatcttagtcacttctatttattctttatttttcaataagttaaaagaaaaaataagtgaataagtgaataagtgactaaatttttaaaaaaattatttttttatgaaatggtgatgaatgggaaagaaaaaagcccagcgggtaggctaggcgttcaaagttatagagtagattttatagagcaccgttctacataatcgccccactgttgcatcacttcgattcgttgctcaaaataatctgaacggttgtaggcttttcttgtttgatctgcgatgatgtgagatagacaagcctcaatcacatcataattaattagctgttcatttaagtatgtgctggcaatagagcgcaatccgtgggctgttaatctgtctttatatttaccgccaacaagtagctttattgctctattggctgtctgtgaactcattgatttattcggatttgttccgctctggaaaacaaaacgcttatagcctgtgatgctttttattttttctagaagggtgatcgcttgacgagataatggaacagtatgcgaacgtttgccgcctttcattttttggggctggaatagtccacgtctttttagcaaaatcaatttcttgccattcaacagatacagcttctcttggtcttaccattgtgagcagttgccatttaatcagaattttgacttgtatcgagctattactatcatctaaatcagataaaaattcaggtaataattcagggcgtatggtcgggttattttctgcagtatgcgttgagaaatttgcagatacattcacgcatttattaaactcaatcaaccccatatttacagcaaaatttagcacttcattcagcaacctaataacacgatgcaacgtatcgcctacaccacgctcttttagtggctcgacggcttttatcaccattttaggggtaatctctgaaacggccacattcccaattttactaaaaagatgattttccaatcgggcccaattcttttccattgtcttaggctgtacttctaacgatttcttttcacgccatttcttagcaacagcttcaaatgtgttttctctttttgagatttcttcatctacgatattttgacgatgaactttaggatcgatatttttcgcaagtaaagcacgccattcatctcttatcagtcttgcttgggctaaagaaatttcaggataagcaccaatacctagatttgttcgcttgggtggagtagagaaaggtttatagtaattgaaaagccaaaattttttgccattggcttttactcgtaaaaataaaccttgcccatccataagactataatccttatctttaggttttgctttttctacttcagtattagttaaaggtttggtaattcttgccataatttaggaaccttaggaacacaataattttaggaacacgaaaaataaaaacactgcaagccttatctatcaaggctttcacgatttttaggaacactggattttcaatattataacctgtgttcctaacggtgttcctaaaatttgcgattaaatacgaaaaaagacgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggcgacggttgaaatagcattaccaataaatacccccacagcttccccaacgcttcttgccccaccttctgcaacttgttcaagtgaaaataagttgcggaaaaagtctaaaacaggcgaaacaatcggacttaagccattccaaatagatgaaaaagccgaacctatactttcaatcgttggttttaaaggggctagaccttgcgatacaccatcaataaaaccactaaagaaggctttaaggggttgccaaaatttatagataactaagccacctacggcgattgcagaaatcaccgcgcctacagggctaaatagcattgctcttcctgcggttatcaccgttttagcaaaggatttatatccgccagcggcaaatgctgtggcaagttgtgttttccccaaccctttgactattttgtcaaatacggttgctttaccatttagtttgtctaactcggcaagcgcttttgttgccttaaaaagacggattggcatcaacatacctgatgcaacagtcgctaatccactgaaggcaaatttggcaatataaatacccgtactcagtgtggtcatacccgcggcaagtccaattgcccatttgaccaattgtttatttttctcaagccaaggcgtaaggctattttcaataaagtcctgcgcgatactggcaaactgtttaatatcatcggcaaaggcagatccaaatgtgccgacagcactatcccaaacaccgccaagagcttccaaagcagcaccaagagttttcgtttttttcagcaatacgatcttgtaaacttgcttgctcacgcatcttggtgagcatttcctctaaaccttttttcccttttttagccaaaatatctgcaagacgaccgccttcgataccgaacaactcttctgcaactaaaccaacaccttcatcaccaaatttagctcgaattttctcgaacttttccatttcagtgagcattgcatcaatgcctttaaacttgccttttttatcccagaactcaaaactcaccccagccgcttttaccatatcctgagcttcggctttcattcctttggttgcggctcgcatcatcttcggccctttattcatccgagaaagcatcatattaaatcccgtaccaaaggtcgaaccctcaagcccttgaacgcctgccataccttcaatagcaagaattttttctgtgttttctgctccagttaatccgagtgaattgactttcggggcgtagtatttcattgactcatagacttgctcttttcttagctctgaagcaaacatagctcgttgcaaataatcagctgcctttggtaattctttttcacttaacccgtgagactctataaattttgcaagaaattcaccaccggcataatgatctttaatatccaataaaatgtttaattccgcggatgttttaagtgcaccaccgactaaaacatcatcagaaataccttgtttttttagagcctcagcgagttgatagaaatcttttctcgttcccggcagatcttttcctaattcacccgcaattttgcctatttcattgaatttaccgatagtcccatcggctttcatcattgcaattttaagattattggctgactcttcttgttcaataaatgtttttaccgatgaccaaacaggcattgccactgcagcggttgccgcagtggaattaaaaattttgcctttcagttcatctctatgggctttgcgctgttcttgtcgttcaactgcttttgagagtgtttgttgtgcggcttccgagcgcttaatagctttagtaaaaagctgttgtttttcaacggctttactaatgctggcttgcactttctcataacggcgcaccaacttggcaacattttcatcacctgttaggtaggccttggatattttctgttgtaaagcaatttgtttttcttgcgacttggcaatttttgagcttaatttttcttgagtttgcatagccttgcccaaaccattacccagttcatcaatggtttttcgcgctttgccaaatgctgcaataaagctacctttaagggcagccccaataaccaaaccaattgctaattcatttgccatttaagttatcctgtgataaaaatagaacacattgagagaggagattagaaatgaaactgcgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgtggaatattgctcatagccgttgttgcagcaatacccgcacgaagttgacgcccttctctctctaacttcgcacccaatctatgtgcaacattatacaactggctaccattaatcgcatcggttgaagtagaagaaatttcccctgttgcaacattttggatacggcgctcatcacctgcagcacctacggaaaccacaccgtttgcggttgcaccagcgaagccatcataaatcatgttacccaccgttacacttgatactgtaccagtcgatcctgctgtagtcgttgaacctctagaaccatcttgtttccagtttttgagagagcctgtttgactaccatcaccagctgtagccgtcgtattgttacctaaataaacggaattctcaaccgtcccttcaggagttgcagacatccaagttaatgcaccattactatcacgcttattattcacattattaccaagaacaaaggtattgcttgatgtaattacattatcattaccgaatgcatagcttccatcaatgcctttatagattggattacctgcactgtcagtaccaatttgaacaccacgaatgatattcgggtcaccaaacgcacctgatttattcgcaattacttggttaccagtaccgatagcaattgagtttttacccgatgcggttgcacctttacctatagctaatgcattatcacccgccgcaacagctttataacctatagctgttgcataagtacctgaagcacttgagtcaatatcgttagatgcttggttaataggctctgctacaccatcatttgtatggaagaacttgataccttgttcgttcatattatgaatcgcagtaatcacagagtttgtaacaaactcagtttgacctttcacgttgtaagtggtaagtgtgtactctttagcttgtacaatctcgttaccatcagcatccaattcaggattgccattcttatcgcgtttaacttcagtaatgactgaaccatctttgtccttagcataggttactgtagaaccatcttttttctgttcaacttggttaccattggttaaagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactttctgttgaaagtgggggtatcttaaactgaattgggggcggttgtcaatgcggttttttaacgagaaccgcaaaactcgccttacttgttaccacaacgcataaggattataatttgtacaaccacaacgtataaattaggatttgttatgtctaatcaaaagccatctcaaccaaaaccacaaccggctccacctaaacctcannnnnnnnnttatagaaagcctgaacctgtatttattggcgatagtgtagatattcctaagaagaaataattagggtaaataatgtagtaaacttgaactaatcaccattaataaaatcggcaagctgatagcagtcataatcgctctatcagtatatttccggtatatagcattggtattaagcaaagataaaatagcttggttgatgttatgtaattcatagcgtcttagtatgccaagtttatttttatcttggctgtttttgaatgattcgttataaagattttgtggaatgtttgttcccatttgtcgtattttacttaataaaacgtaatgagttagcataaatgcggatattgtccaacccgccattagtaaaatggcattgacaataataatgggatgtattttatcaatgctgtttattagcagtaatgagatagaaccaatacccaaaagcagataatttaataggcggtaggctttttctcgattgttttcgtttgatttttttacatcgtcataactctgtaaggcttgtttttctaaatattcaagcatttcatcatcaacatctaaaaagtaatcgtcgggtaagttcattataattctccaaatatttagttaaaatagctgaggtgctaaaggataaaaaagattagtcatcttttaattttccatctagataatttagaacccattttacacagtataaggcaataccaatataaacaagtgaatatataaatgttgaaaatgtcattgttgaatccttaataaaaaagcccacgttttgtgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtgtaataaagcttgtttggtttcaagtgcggtgagttttttctcatctttttccgtttcaatatcacggaattttggacggacattgttgtaatccactttgaatttcaacactttttcatcacgaatggcatcggtaatcacataagaatgtaactctctaccaaaaacactggcagttgtttctgcacctaacgcattttctgcaaatataggtgtgcccgtaaaaccaaattgacagaatttcttaaactttttcttcaaattcttttgtgcctcgccaaattgtgaacgatggcattcatcaaaaataaacactacaggttgttgataaatcggcagattatcttccgatttcattaggttgtttaatttttggatagttgtgacaataattttattatcatctttttcaatattccgttttaaccctacggtactttcagagccatttacactgtcaggtgaaaaacgttgatactctttcatagtttgataatcaaggtcttttctatccacgacaaaaaagactttatcaataaaatctaactctgtggcaagacgtgctgctttgaaactggttaatgttttaccagaacccgtggtatgccaaataaatccgccactttcggtattattccaatttttcgttaaataggtattgtttattttccataaaatacgttctgttgctgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatggtgcgttgatttgctacgctggctcaacgctaagcctcgatagccatctcgtgggtatgcacgaaatggttaaatttattacttgcgtttgtgctacctgattcactgccagtgcttaacctttccacaagtaatcacaccgcttgagctatggctttcacatagcttgttgataccatctcacctttggcaagcggtgcgtttttgtctaaattgtgtcgagatgaaataatggaattagccgcctttttggagtaatctacgcattaaccttgctatttttgaaagcgggttttcagggatatatactgaaagatgtatctcgccatcaacggtcgcttgggacattgctttgactttttcttgcgcctcttcaaatgagttggcataaatttctgttgcccacttctttccgccgaagctataagaaacagcatagcatttcattttttcgtgcataagaagttacctctatgtattttcaaattttccaaggtgttaatggtcagtggtattggcgattgtgtcgcgttttgtctagtggcttgattgatattatttcaacaagccatcaagcctattcagataaatctgtttgtgaaattgatattatgaatgtcaaactcacaaatgctacaacgccaattcgttatatttaaccttaagycctgttagagcagggctttaaatccgtatcaactcccgacaactacgtctgattttctctttggctcgaactgttgttggtttgattttgcctttgttgcaagcgtaatttgcaatatcaatcatttttttgcttggtctttcaaggcaggctatatctacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgtttttgtgaaaattttgcaaaaacagaccgcttatgtggaagtgcttcctcatcatttctcttcttgctctctgtatcctgccaatatggacagagagatcagcccgcttactcgggactatacaagtaagaacataaatacactacaaaatgcggtgtatatcagattaaccactcctttaggctcgtggtgggtagatgggcgtgtaggctctctgctccatcttattaaacgtgagaaagatttaagtcgtgttggtttattggctcaacagtacgctgaagaggcattacaacccttattagacgacaagcgagcaaaatcaatcacggtaacacatcatcaagtacgagatggttcaattttgttagaaattgaggttattgataatcgtggtgatacttttaagtttgagcataacgtaaaactaatttaaacggggtttaaatgtttattacaccaactttagatgaaatccgccaagcgattttaagagatgtggtatctcttaacccacacgctgatgtttcggttgattctgataactatgcccgtgcaagtagtttagcagccaccgcagaggggctttatgctcatcaaaaatggataatcaaacagttttttcctgatactgcggatacagagtttctagagaaacacgctgctttgcgtggtatttatcgcaggcaagcaacctatgccagcggatttggtgctgaagttttggtaatgctggagctgtaattgaggttggtaaacagatgcggttttatgaggtggttgaacctgctcagattactcaatcctctgtaatggtcaaagtcaaagcactttcgacgggggcaggtcaaaatatcattcaacctgttactgcgaactttatggcagcaccagttggggtacagaccgcttgtatattgcgtgagattgtgggcggtactgatgaagaaagtgatagctcactgttagagcgtctgcttaatcgtatcagacgaccgcctgctggtgggaataagtacgactataaggaatgggcgttaaatgttgatggggttgaagccgcatttgtctatcctttgcggcgaggattaggaacggttgatattgcaattactagcaataatgatttgccgagcgatgaaaccgttgctcgtacccaagcctatattgatgaagttcgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataaaggataatgtagcttatcctgtaaaattatagtaatcttaacaagtttttgattaaaaaggggtacaaaccttgaacgatatgtttaaaaatattttgctttgggcggtaattggtattacgttgatgacggctttccaaggctttgaaagcaattttaatagtgcgaatacggtggaatattcgacttttattgacgatctgaaacaaaaccgcctcagagaagtgaattttaagagtaacaatgaaacgattactgtggcaaaggttgatggttcagaatatcaaacggtaatgccgatgtatgaccgtgatttgttaaatgatctcttaaataaaaacgtcaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcggtgtcaatatggaataaaaaagcctacgaggtaggcttattcattctcttgttgttgcttttctaaaacacttgctttgcctcgtccaaatcctgcccagtaaccagcaagtaatgcaccaccgatttttagcatttctaatgcaaaatctgttttatctgtgtacattgcaataaccacaataattgtgataacaacaacacctacaccaattaagatatggcgttgtgaatgaagtttagaaactgcagtaatttgttgagtgcgatcgcctttttgagcttcaatacttgcgagtgcaattttctcattagattcaatgcgtttccgttcaagctctaattccttttcttttacagcctgattcgcttgttgaaccttcacaagatctcgcattgtagcaagaagttgtgcgtccgttggttgtgggtttttattattcattaacgtactggacaaagctgtggcgttttataagtgatttggaatgaaccataaccaccagagccaattttaggtggaacaaaagtaacattctggatgttgttacttactgtggattttctcgcttcgtttaagtactgtttcgctgaaacgttgcgaacctttttaggtacaagcagtggcgttttagtcatatgaaataccttgtttgagtgatgaaaatcccttgtgaaataaggattttatataaaaaaacacattgaggtggttgtaaactttctgttgaaagcacggctatcttaatccgaaggggcggcggttgtcaaataaaaaagcctgcggaaatagcaagctttgtggttattgtttgggtttatcttcgtcaatccatttttctgcaagccattcaaactcacaaaacagtttattgttgttatttttaatacgacgcaattccataatatagggtttcaacgtattccagtcagtgattacgctacttttactcattcgtttataaacggcttcatcaaataaattctctttgatgccaacacaaataaattcaatcgagttgagaatatcaagtacgatgaaattttgtcgatttgtttcatctgttgcttctgcatgtttttcgagggagcaagctaagctcgtgaagtttagccccccatcacgcattttcatataagattttcggcgtttgcggtaataggcattattgctattgctgataagtaattcgatagttgctttttgtttgtgctgttttcgtaattctttcagttgtgaccacgcaaaataggctaggtaacctgtgaataaacaagttcctagccctacaagcagattaatatcaaagttaaagttactaaaatataccagcatttcattggtggtaggttgaggcattaaacttcccatccttcatttagtgaaaaaccgtcccaaccttcgttaattgatttagacatttcattactcctaatttaaaactaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgttgcaccttcaggaacgtgaacgtgaatatcacgtttttcgtggaaatcgctcgcaatacctaatttttcagctcttgcacgcacgaccatcattgccgcttgaatggactctttcattacatcaccaagagaacctgtgtaagagaacttccctttaccagccacagaagaggtttcaatcgtcaatagatcaccgccaacttccgtccacgccaaacctgtcacttcgccgatacggttctggctatccattttgccgtaatcaaaacgctgtacgcccaagtaatcttttaagttttcttggctaacggtgatcgatttaagtttcttatccatcactaacgcttttaccgctttacgacagattttcgcaatctcacgttcaaggctacgcaccccagcttcacgggtgtagtaacgaataatgcccaaaattgcactgtcatcaattacgagttcccccgcttttaaaccgttattctcttgctgtttcgcaatcaaatgctctttcgcaatatgcattttttcatcttcagtataacccgaaaggcgaataacttccatacggtctaacaatgcaggcggaatatgcattgagtttgatgttgccacgaacatcacatcagacagatcataatcaacttctaaatagtgatcgttaaaggctttattctgttcaggatcaagtacttcaagcagtgcagacgcaggatcgccacgcatatcttgtgccattttgtcgatttcatcgagtaagaaaagcggattcttcacgccaacttttgccattttcatcatcaactgccccggcattgaaccgatataagtacggcgatgaccacggatttccgcttcatcacgcacgccacctaatgccatacgcacatattttctgcctgtcgcattcgcaatcgactgaccaagtgacgttttacccacacccggcggcccaactaagcaaaggatcgggcctttgagcttgttcaaacggctttgtaccgcaaggtattccaaaatacgctctttaacacgctctaatccgtagtgatctttatccaacacttcttgagctttttgcaaatctttcttcacaacagaccgcttgtgccacggcatttgtaaaatccagtcgatatagctacgcacaactgtcgcttccgcagaactttgtggcattgcttttagcttattaaactcgccgtccactttttcttgcacttcttttggcaatttcgcttcggcaattttctctttgagcttatctaactcgctctgttccgcttcttcttcgccacccagctctttacgaattgccttaatttgctcgttcagataataatcacgctgatttttttccatctgctgtttaacacgattacggatacggctttctgtttccattgtatccatttccgttgccatcgctaacaacaaggcttcaaaacgggcaataagattagcttcttccaacaatgtctgtttttgttttaccgaagcaatcaaattcgcagatatcgtatctgccaagcggtcttcaaaggtaattttttgcaatttcggcaaaatttctgtaggaacttttttattgcttttaacgtaattttcaaattcgttgagtgcagtttttgcaatcgcttttaattcttcgttatcgtcttgataatcagaaggcattggagaaacaccagcccaaaagccactttcatcatcacgaatatgctcaattttaccacgcacttgaccttccaccagtactttcaccgtgccgtcaggaagatttaacatttggattatatttgccattaccccgatatcataaatatcttctgccgtaggatcttctttgtttggatctttttgtgtgactaaaaacagttgtttgttggtgttcatcgccgcacgcaaggcttggactgatttttctcgcccaacaaataacggcattaccatataaggaaacacaaccacatcacgcagtggaagtaatggtaattcaataggtttcttttttcttgccattggattgctctcctaaaatagaattcgtacattatgggggctaatttaggaaatacaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcaagaaaatggctcactatcaagatatttccatcgcattagctggcgtatgccagtctgcaagccttgttcaacaatttgcacataaaggctttgcggatcgtgatgcatttagacactctctttctagcttacttattacccaacctgactcaacacttgatgtttttgggggcgatttagcccatttgaagcaagggttagaaaccgcattggctcaatttggtggggcgaatggcaagctcgacacagaaattggtcgctattggatcagcatattagcattaagccaaaagttagctaaaaatccccaagcaaaagcgaatttagcacaacgtttgcaacaacttgaacgccagcttgctctctatgataacgatattttgcacgaacagatgattgcaaatattgcgagtatttatagcgatattatcagccctctaggttctcgcattcacgttttaggtatgcacgattatctctctcgccctgatattcaaaatcgagtgagagcgtcgttattggcaggtatccgtgcagggattttgtggcaacaaatgggcggtagccgttggcaatttttcttttcacgccgtaagctattagaacatactcgacagttatataaatccttttaattaaagagtagtatccgtaataatattaaaatgggctcgttgtaaagaaaatttccttcttcccaacactttggtaactatacctatcttacaatggcacatgttttacttaatcaaacatgtgccattaaaggcttacaaaacactaataccgcttaatctcaaaccccttctgcaatgcttccacactctcaaccttctcaaagccttttagttctgcgacttggctaattttcggatttttaccaacggcttggctggcaaaaacaaaacctgtttggtcgataatggcctgctgatagaaatcaagaatatcttgtttagtgagctgtttaatcaattcaatcacttttgtcttacggtcaaactgcccgttgcctcgtgaaaaatcggtgacaaattcagcaaattcttgatctaaggactctggcttatgttgtaacacttcaagtaggcttgctcgatatttttcaaactcttcggcactcattgcgttgagtttagccaaactttctttgaagaagcgttcattatgttgcattatctcttttggtgaagccgtcgggctttgtaccgaaaattgcaagcctgatgtagtgccgatacgggtgttataggcataaaccacataacctagctgtttatctgtacgcagatcatcaaaataccaacgtgagagaatatcttttaataaactggcacggcttaatccctgtaactcatcataaccttttgggaaataggcgattgttaaggcgttatcttcgtgagaaatctgtttaatatgatttagcttgcgttggctctgattaatgtcgagataacgtcctaaatcaatctggctattttgattgttaaagaccgtttcgacttctgttgcaatctgtttcacttggttatctgaaagatttcctaccgcaagcacgcgtaatgatgtcgctttgttcagcaatttttcacgcatttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatcctttataaccagtcgccacaatataaacttcacgagaacgatcacgagaagcctcaggtttacgcacttttactacgttaaataatgaacgaatttcacgcaaataatcatcaaacccttccccttggaaaactttgacaacaaaactgccttttggtgctaacacttgacggcacatatctaacgctaattccaccaaatacatcgcacgaggaatatccacagaagacataccgctaaagtttggagccatatctgacatcaccacatcaacttttccctcccctactctctctaacaacgcatttaaaacgctttcctcacagaaatcgccctgcaaaaaatcgaccccgacaatcgggttcatatccaaaatatcacaagctatcacacgccctttatcaccaatttgcgtgacaacgtattgcgaccatccacctggcgcagcccctaaatccactactgtcataccgtgtttaaacaagcggtcagtttgttgaatttcatctaacttaaaataggcacgagaacgaagtttttgcttgtgtgccttttgaacgaattgatctttgaaatgttctgcaagccaacgagatgaacttgcactgcgttttctacccattctctactctgattatccaaattaaacaacaaatgtannnnnnnnnnnnnnnnnnnnnnnnnnnnnnnnnnnnnnnnnnnnnnnnnnnnnnnnnnnnnnnnnaaatgtaaatctataaaaaatttccctctataataagggtgaaatggctgatttcaagggaaaagttaaaattttgtggcgaaatgatggaatttgcaaaaaacagctcggatctgaccgcttatatttgctcgcccccctaatttttcgttataatcaccacaatttttgccgttttggcatctttttatttaaacagaggacagatttatgggctttttagctggaaaacgtattttagtaacaggtttagcaagcaaccgttcgattgcttacggtattgcaaaagcaatgaaagcacaaagggcagaattagcctttacctatttgaacgacaaacttcaaccacgcgttgaagagtttgccaaagagtttggttcagacatcgtattaccgttagatgtagcaaccgatgaaagtatcacaaactgctttgcagaattaagcaaaaaatgggaaaaatttgacggttttgttcacgcaatcgcctttgcaccaggtgatcaattagatggcgactatgtaaatgccgcaactcgtgaaggctatcgcatcgcccacgacatcagtgcatacagctttgtggcaatggcacaagcagcacgtccattcttaaacaaagacgcagcattattaaccctttcttacttaggtgcagaacgtgcaatccctaactataacgtgatgtgtttggcaaaagcatcacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagagttaaaccagattttgggcgaccacgagagcgtttttcagtttgcatagaaattccttgttgatcttttaagccaaaaggcttatagttggagccgtcagggggacatccgaccttcccccttcaggagttaccttaaactaccgtacctgaacaacaggtgagtaatactacggtaactaggattagaactctgaaaatcttcatatcctagctccatttagtggcccagtgaaagctgggcttcttattttcagaaccattccgaaaacaagcatattttaggttaaaccaaataaataatcaagatatttttaaggttaaactaaaataattaatgtttttgtatttgacacccaccgccctttcagtttaacattatctcaatctaagccgtctaacacggctttttttgtatccaaaatttgaggtgcggtatggtagctgaaacacattacacaatagacaaaaatatgaaactactcatcgaaattgataacagtgaaccgctacaactctctaccttttgccaaagtatggaagggatagctgcagaataccgccaatttatccaagacaacaaaattgaaattgagccttgcgaacagcatatttatgtggaaaaaatcacacaaggctgtttccttgttgagcttgccgcactggtttcaagcacctacccgataattgaacagggtaatgccattctcgaatttggaggacatctcaaaatgattttagactgggcaatgaataaaggcgaaaagcccgaacgacttacactggcaatgttaaaaaatgctaacaatattttagaacctatcgctatcgaccccaaagcacaattcaatctacaagtatcgaataatcaaggcgatgtgcatattcatctacacgccgacaatgcaatggcagggctagctcaaaataacattaaccgagaattgaaactcctcaaagagcgtgaagaaaataccttacgaaacaccacgctttattggtcgtccaccgcagacgctcaaagcaaagctcacgacagagccattatccctgcgatttcatcaaagccagtaagagtgcgatttgaagataaatcacttaaagacaccatgatcatcaacgaagaatacccttatcacaaaatcttcttggtggatgttttagtggaatatatcgaagaagaacctgttatttataaaattctgaaactcaatggttcaatgaataaaatctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcagtcagaactagattttagaaatcgtgctactgtttcattgttggttatttcacttattacttcagcatcactgtatttgttgatcgcagaaatggctttgcaagcctttagttccaaaccatcataatacggagtaattttgatggaacttagaatcgcttctataatttggtgtttttgcaccaaattaacggttgagcttgttacactttccgcttttgagtagttttctgtgttcattttgtttaacctcttttgtttgttaccattcagaaccgctctcagcaagagtgaaaaattcacattaaaaaagcctcttggttagcctgaaagcggttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataagtctgcgtccacccatccgaataatcatattcaagcggattttcwrmttgttccaccatcgccttatgcttcaaggcattagcgtgattgccagtcttggcttccattaacacctgccaaatgactaacaatttttctttrttaatcatcgccaccgaattatcggcgaacgtccacggaatttcttggtcgccgaataaatcaaacgtcgctttgactgacaagatgttacgctctgctgttgcgtctgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggaagattttgtgattaagccgtttgagcaggaggcctaaagcccatttaaacgctctttaaatctccctctaaccccctctttgtcaaagagggggaacggtgaaaggggcgttaataatgtgttttaaccataaggggtaaatggtgaccgatagcgaaaaatggcaaataaaagaccgcttgtatgacttgattgaaaagctacannnnnnnnnnnnnnnnntcgaaatggacgattttgcactggctggcgtggttttgatggacgtagctgggcaaattcagcgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatgaaaccaaagatacaacggggaactcgttacagtcagattctgcggattcagttaatgcaacagatgaaaaagtggtagatgcaaaggcagatggggaattaattcagccgattgcctttgaaatcactttaaaagcgattcacccacaagcaagctatgggcgttgcggttatcgctttaccaaagagaaagcggtcgaaatcccatttgatgccttaacgggtgagcagattattgcactttcgcaagatccttatcttgagcttgtgccgatttgtgagaagtagcgatgtatgccgatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgctcaggagaggggaaggcaagggactttgtctgaagcggagatgaaatctcgtttggaacgcaatcaagctatcattgacggtgaaattcgcccaagcgtcgaagcaactacaggggctttatcaaattaccaagcagactttcaggcttttgggcggtctatttctatggcaattgaggctgggcttacatcgcagtcgcataccttggcgaataatatcaccctcgaagtcgatgggcgtgtgttggctgaatatgtgtctaatgagcaatttaattttaataaacgggtggcgtagatgggtggttggacaatgcctgttcaacaggcaagttttaaaggggtgcaatttgatgttattgcggttgatgaaacttttgataaagccatcgcagaacacacttacccctttgttaatggagctgatttagaagatatggggcttaatccccaaacaattaagttgcaagcggtctgttttggtgagggctattacactgattataaaaaattacttaatgtggttcagcaacgtggggcagatgtgttggttcaccctattcgtgggcggatcccgaatatgattttggtatcagcaaatttacgtcacgatgccgaaaatgtgaattatgtggcgttagatttgacgtttagggaggctacgccattaaaaccaatttttgtatttgagcatagtttattggcgaggatagatcgttatcttaatcttgccgataagtttatcggcgatatgttagcgtggtgggcgaaaggaatggaggttatagcatttgctcacaatgctaaaagtcgattgttatcacaatggagtgcgatttttggctgttttgagcaacttaatgccttatttgaattaagtcaaaatgcgaatactttacctgtcggggttagtaagtcagattttcaaaagcagagtgtacaggcgttgcaacttttttatgatgttgttttagctcaatcaaaaacacataaatttaatactacgttgggagtgaaggcggaatttaatgagttaatgcgtgatattgataaggtgttgaatatcccacgtctgttagttacaggacaacatcaacgaattacctctgcatctcagtttttcgcaatgcaaaaaaatggtcggtcggcgataaaaactcgtttatcggcagatgatgtgaaaagcctaaactgtgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattttgcaaacctatccgacaatccaaccgcttgcgtcggttgtgccacacgccccaacaccgcttcaccctcttgagcttcaggaatacctaacttatcccttgcccaatttgcagggatttgtagcccaatatccaccaatttcggcaaactctcagcgaacaacgccaaatctgcaggttctttggtatcaaattcaaacgtcggaatacgagtaggatcgacattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttacacagaatttgggatagggtcggatagggtcttcgccaaacgttctttttccgcctgttcagccgctaaacgctcggcttcttcttttgctaaacgctctttttcagcttgttctgctgctaagcgttcagcttcttcttttgctaaacgttctttttccgctttttcagcggctaatttatcagcttgagcctgttgttctgctgtttgtgaggtattctggtttacggtgctatctgatgagccgccaccactacttccacaagccgttaagcccaaaagaatcaaacttgctaaggttactttttttaatgacataagagtttctccttgaaataaaatgctgaaaatatccttgtaattatcctttttctaaacaattatttatcaattaaattatttaaagcgtaaatcgttttattgataaaaaagatttacagctattcataatgcagaaatgcactcagaatccgataaaacaggctttagcaaaagattaaaagtcgccttagaattggctgggcttcaatctttatctttagctgaaatttcaaacaaatttaatcttcgtcacccgaacaagcctgttacaccacaagcggtacataattggctgattgggcagtctattcctacgcctgataaagtcgaaactttgtctaaatggctaaatatcagccctgaatggctacgttatggaaaagagcattttgaaggggagagcctttctcaaaatgaaattttaatgttgaaatattttcgtaatttacctgctaaccgccagcaagcgattttggcattactacacgaatttcataaatagataaaatgactggcgttaattcaacgaaaacagcataattccatcgtttatttagtgagattaatctatggaactcaaactccctcctccattagttgcactgatttgtgcaacaatgatctattttctgccgaactatgcagagccgaattgggtctatcaaagttttgcgataatctgttttatatttggggttagcgtcgatctctgtgcattgtgggcttttcggcaaaataagacgacaatcaatccgcttgctcccaataaaacatcagctttaacaacacaaggtatttatcgctttagtcgaaatccgatgtatttagggttggcaagtctattatccgcttgggcattttggctaggcaatgcgttcgcattgcttgtcgtgtggggatttattgcttatataacccgttttcaaatcgagccggaagaacggattttagaacagaaatttggagagagttatcgccaatataaacaaaatgttgctcgttggttgtaataaataaaggggctgtattagattagccctaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttagttggcgatttatctggaatgtggcgttatcgtgtaggcgattaccgcattatttgccatattgataatggcgagttgttgataaccgccttagaaatcgggcatcggagagagatttatcattaatcaaaaccgaaacactttttcttattaacaacttgatattcggcttctagcttgtctgtatgctctattagcctaaattcattattattcttatccgattcacaagaaaatagcaatgactcattagctacagatagcataggagccgacatcaagataaatggtaaacaaaattttttcatcacactaatcccgtattgaattgtaatcccgacatactcgttttaagaccataaacagcatcttgagtagtccctgttatcgttgatgcactagagtgtacattaactccaccgttgattacaacttctgtgcgttgattattgttgatgttttgaggttgagcaagattttgcattgtttgtcgtgcttgttgtgttgcatttaaggctgttgctaccatatatccaccaactggagcattccaatcaatagatttgctctgaataggtttgctctgtttagccaactgaatcgccttttgacctgtattatagtaatcagatatttttgttccattaccatctgtactatctataccagagtttgcgaaggctttcgctccgcctgctccttttaagtgagcggccattagtaagccggctttatgctccgctgaaccttgataagtagagcctaaataccccacattcttattcataagagctacgattgcattatcttgaatggctttactactcaaaaatgcctctcgaccacctttgatggtccagttacttgaatccgctaaaaatgctttgtgaacatcagcatcagaaccgttagataatcctttaccatattttcttactgctgctctatatttagcatcatcgattaaccccgcatcaactaatgctgccgcaccgaactgatataatcccaaatatccatattgattttctgctctaaggtttccaccgctttcacgcttgaccatttgagcagctaacgctcctgtttcttcttgtgttagccccttagctgatttctgcccttcaaagacaaagtttcctttgctaaatcctttcttagtatcaacaaacccagcatttttactttgttgagttaatgaggcttcatcactagattgaatttgagcggctttatcaaaagcttctggagctcgctcttccacgccattccaccagttttgaatacttccccaagcatctttcgttttttgagttacccaatctacgctatcactacctaggctctttacttcctcccaagcaccttctaagtcaagcgtaatgattttgtacaaaatccctaaaaggcgatcaaatacaggcattagatactcaacaatgtcttcccctaggtttttaaatcctgttgctaacgagccaacggataaaccgttttcatcaataaaacctttaagttttaaccaagacttaccatcttcagctaaagcattccaatcttcatattctgttaataaataagtgaaaccatctactaaactgcgaacggaaaaattagctttatcaaaccacttaataaaagccccccagttaaacagggaattaccaccctctgcccattttttatagtcatcatagagcaatccgaaaacaccagccaaagcagctacaagtagaattgcaggtaaaaacggagccataaacgctaaagcggcttttgcacctgaaagcaatgtaggaatgagaactgctgtcattgcaccagctattcccataaatacgcctttcacaaggttttcatttcggcttaaaaactcaaagaattttgtggttaattcgctaatggttaataaggctggagccgccgcatttgcaatcatcagttttagtccgtcaaattgctgatttagcattgagacggatttattcagcttcttagaggtttcaatatcgtcttggttggatttgtagattttactctgataagcaagcatctcttgataggcttctttgccttgtgcaagcgtgttaaacgtttcttcatcaatgcctaacccttgcgccataacaagcgctgtgccacgatccattttgctgaacttatccgccaactctagcataatctcttcaagttttcggatattgcccattgcatctaaaggagcaacacctagagcgttaaaaaatggaataacagaagcatcgcccattacctgaaagcgagttaaagcaccagatagccccatcaacgtgttagccataccgctagcacttccgcccattgcttccgcagcaccttgccaagaggcgagagaacggctactcattccaatgttttttgccattgaatcgagttcttgattagcttgagaagtttgcttaactaaacgatcaagcccaatcccagtcataatcattgtgctgatagcaccaagggccttgccaaacccaagaacaccaccaagaagattcttagcggctttctcgttgctttttatttgcttttcgtttttctctaacgcttttgtatgcttatcctgagattttgagacttcgcttgtggcatcgtttaattcagcaacggttgtagatagcccttctacgcttttatttgcttcatccagagcttttgcattgctatcaagttcctgctccatccgctctaacaaagcgagaaatggttttgctaccgcagtaaagctatcattagcaacaatatctatcgcaagcgtatcaattacatcagccattatttgccttcctgttgttgtatgaatctacggtaaatacttcgagcagatctaaagcatcctctaagccgtaaacggtttgtaattcgtggtaagtggctaatttgctactcaccaccgcacctacaacttgacttagattcacatattcgactgcatcaccacctttgcctactccgagatcggggtaggctcttgctccaaaaaatcaatatggagagataacgcctctttgcgtaatagccataaagtcgtaatgtcttgtacatcgccaagggataaatctaccgcacgagtcgcaccgctttcggtgacgatttccacacagtccattagctcatcaagtaacggcaacgccttttcttctgggatttctcttaatgccgataaagccactctagcaataccaagcataccctcttttgcatttggcacttgaaagcctccactcattaaagcgagtaaggcttttgtcgcccatttgtccgctttcgcaataggcatttcggtaattttgaatgtaatacctgcatcacgccctttttcaattgtgattttttttgtttttaacgccattttctctctccatattggttctaaatctcgcttttaagatgcttacaagaaacggtgagcgagagagtaaacaccgctttcgaatgtacttttctatcttgtaagcaataaaaaaccgactttagtcagtcggttaaatatcttcttctgttttcacgacaatcttgaaattgtacgttgcataatctaagacttttttagcactggtaccgctttgggcttgagtcataaaacctgtggcggtatatcgtttaccaattgacggaatcgtaacatcaaactcaaaaggcacggtctcctgttggttttgcatatgcacttttacgccatcaaaaaatgaacggcttggactgtttgcagcaagtgcaatattgaaatcggtttcgctaggaacccaaccaccagactgatagccatctacgcccattgtggtttctgttaccgccgtttggttaaacgtaaatgcgttatctgccgcatactgttcaatctgaacgaaaccacggctatatccaacggcttttgctaaaagcactgcatttgccgaggtaattgttcttgaggtatttgtttgcattattttttctccaaaaagaaaaaggcgacctatttcaagtaagtcgccttatggattagattacattattgaacgttaatagaagcaagatttacggaatgcaagctaccgccgtccgtatagaatagcttcatcgggaatgattcacggtttcctcgtgtttgcgctgtcgctttaccaatgtaaagataatagccttgggcctctacttgtgaagcagcatcaacacccgtgtagttattgatgattgctttttgttgttcgctcaacgaaacacccacttgaatagagccaaagttcaatgcttcattgattgggtcattacacgccgcacgttgcaatgcaataccaatatcattgtaagggactgattttgcactggttagcaatgtaataatcgctaactggagctggctatttaagcggatttggttaatgtaagcgtcgatccatttccattcccctgaaatttgacctggagataggaacaaaaagcggtcgttagccgttgcccaagcaccataatagttatagccattatcttctaaattcttagcaattgtggcatcggtaacatcagcggttaagcctgattgacctttaaacttaagcgtaatacgcccttgtttctcggtaaaatcaattgaagccacagtaccacacaagaatgccgctttatctaaaccaccatacacggccgttgcaccgctatattcagattcttttaacttagcaccaaaacttgttgtattgcctgtttgtgttgcagtagcctctttaccccaaccaacatacaagaagcgttgattctgattgttagaccattttgcaaactctaatttttcctctaatgtcggctctgtgattgtggtaaatgttgcccagttaagcgttgaaccaatcactgcttgcatggtttctgtcggagtggttgtatttgagccttgtgaaagcgtagcacctgcattttcacttaaccctaaagcatctgcagttgcacctgttgcaaacgcaatcgttgatgttgtgccagtcgttgaagaagcaaccttgaatgcttgtaattgactatcaaaagtcactgttacagagcctaacgccgtaccaattaactcagctgcattagagaaactttttgcaccacttaaattcaatgaatctgcttttttctcactgccgtcaataattacactgagtgttccgttaattttcttgagttcatttaacgataatgatttaacagaagcacctaataagaatgcaccttctattgctttattgtaagcaaagaaaattaacgtaccaggtttaatggttgaaccatcaaaccctttaaaataaactgccgccgcttgatattccgcagaagtaaacccgaaatattcacctacagaatccgccgttgcaaatgaaaccgctcgacctgtcggtaaattcgcattttcacttaagaaaacggcattcatcgaaagtggggagccgccagaactcaatacggacggattcacattcacaatctgacttgctggaatcgattgaaacatagtttttccttatagttttccaagctcaatgcttgggtttggtttagtaataaaatcttgagcgtgtacaacaacagggttataagcaagccttgcggttactgtatatctttcttcatactcgctcgcctcgttagtaaaaggtaaatagcgtggttcatcgcaataaagaggctggcatttttccaacctgtcgcaagcgtgataatctcgccataaattgcaaaaaatcctcgccatttgaccgcttgtttccccatagaaatctatttgcatttgcacttctacactttgcataacagaagctaatgcgttttcaacatcataggagtgaacattggtagataacgattgctcgtaaatgatgttcatcaaaataaaaggcgagtgcggcagaggcacattattgctataatctcttatcaccctctcgccttctaaagaaaaaagtccaagcaaataagatcggacttctctgtaaatatcatcgtgggttgtctttatgtctgccgccataccaccaccttacaccagttaggaaagctctcagaaacggatttaattagccattcagattcgctctcttcgccaaatgctttaaaaacaagcttatccgcaccttgatttgaaatgcgtcttagcgcgtggatttgccctgaaacatacacattcagcatttgcccttgttgagccaacgtatcaaacaaagataaatcttgcgtactcagactttgagcctgaatgctgactttgaactcttcaaactttgatacacgcttgcctgtgtcgcttgtttcatatcctgtgtttagttttagtgttgcctgaatattggggtttaccgtggtgatatgttggttggcaatctggcgtaaattcatctaccctccatatattctcgaataaagcctatctatcctaatttttagttgatagtccctcaaacgttggtttataattcgatcagaggcgttattgtcaatgtagagagctgtgtcacctacatttgagaaactggcagtgtccgaactcttgcctgtgacataaacgcctttttcaaatgctgttaatagccactttttttctttatcttcataagtcagtcgaacaactccacgatatttcccatcttcagatcttaatgcatcgatacggcttaatagcttatttaatcgctgattaatgttgcttttttgagtgttttttgctaacttaagaatgtcccctacagagcggattgaagtcgggtcaagcccatcagcttgaacagtcgagtcaacccattgagctgtaggggatttttcatttaggttcatataaaatccttgattaaataatcattagagctataattttaaccaatgaggcagcgtgataatttaagaggtaccgcacttgaacgcggtaaggtgctggattattacgttgcttctattctcgcatataaccatgatcataatacctacgtccatctttataatgtttgattgttaatatcattttggcatttttacccataacattcatttcagctttataaatctcaaccgataaaacattaggatcgcctcttttatcttgctttttatgcattaaagtcgctgtttcaattagttcaggtatggcagggatcgttttaatcaaatcctctgctgcacccgatatagtatgttttataccactagcaccgacctgaatttcattacctgtacttaaattaacaaacttctttccggagaaatgttctattgcataaagccttgctcgtgttctcagatctttaatgtcttttgcgttacctaactctttacccgtcacgctaggtatttttgttgcctctttatccaagtttttcttagctgaaccagcccctttcccaaactgaccattttcagctctaggatgtttgctttcatcccaatctttatcacaagcacataaaagcaatagcctttcaatccgtttgatattagtttgactaaaatgcatcaatcccccttatctgtcacgatataggagattgagctgattaatacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttggtttagatgaatatgccaaaatgcctgatgtaatttttgatgctgatcgggttttaaaatctattcaaaatgaaaaagtgaataaactttatttttataaggagattaatggtcgttggtatatggtcgtagtaaaaaatcttatttctagtggagaattgtttgcagagtcatttaggttatctagcttgaaacagatagaaaaagaaatgaaaaaatatgaaattattcgaataagccgttaggcagggctcgaaatcacctgcacacagtccaaggtactttttcaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtgggcgttatcgcttgcctttgagggctgtaccacaaaatctgacacgcatttgttgtgatttggctcgttatcatctgaccagtaaatcatcggtaacaatgaccgaagaagtcgaaaatcgctataaattttgcttaaaagagcttgagaatatctcaaaagggattgtgtcacttgggcttgaggaatcctccgttgaggatatggcaaatggcgacaacagcgtgcagttttttaatggcggtaatcgtatttgggggcgtgaccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaaagcagctgaacaaggagataaaaatgctcaactttatttaggctttatgtactatgacggagaaggtgttagacaagattatcatcaagcagctaaatggtttcaaaaagcggctgaacagggagacgtaatggctcaaaataatttaggcgtaatgtacagcgacggacaaggtgttcgtcaagattatcatcaggcggtcaaatggtatcaaaaagcggcggaacaaggggacgcatcggctcaatttaatttaggcttaaagtaccaaaatggacaaggtgttagccaagattatcatcaagcactcaaatggtttcaaaaagcggctgaacagggagatgcacaggctcaatataatttaggtgtaatgtaccacaaagggcaaggtgttcgtcaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggcgagtacgattatctaaaatagcactatattgccaataagggcgattatcgacattatccattagttgttgataagtttgagcagaaaaggcagcttgcatattcgtgcgataaatcgtttcaaggcgacgggggggaccaaaatattcccccgttttcgggtctgcaataacatactctttacgctgtttgtcgtaacctgtaatccaccccttacgctcaaacattgccatcacatctttcacccaagcattataaggttgcttgtttcgtttggcttctgccattgattcataaatatttacggtcatctcaaggctagataaatttgcaatgcgtgaagctctcgctcttgcagagtcacgtaacgcaggttcatctaaatgtttcgcaaatgcctttttactttctaaaaactcaatcgctttgtctggggttaaatcaagggcaaatttagctggcacggctcaccccaagcaattcagagagaaacatcgccttattcaaataatcaaaatgctgtttagaatgcaatttagggtagagttccgccagtttctcacttgcttcttcatagcttccgcaacgatgtaacattgagacaacttgtttaatcatcggatcaagttgagcattaaaatccacattttccaacgcttcatcaagcgaactatctaaaaaagcctgctcatcaaagcctgactgtgccgaaaacacgtgaacttttcccccacacccacaaggacaataatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagaaaatattcagcaatcaacaatagaaaatgctgaaattaatcctatctcagataaatttatccaagatgttgtaaaacaaggcgagagttttaatttagaagtgcaaaatagtacagttattgttccgaatgaattaaaagagaaaatgaatatggtaaagctcaataataaatttatagcatcagttgaaaatatccgtattccgcaattctttgaaacaatgaataacggactatttgaagatgttgttttgtttgaaaaagaaaacttattaacgaaatttgaattgaaacgatgtgatacacaaatttctttttcagatttagatcctgaattatatagtgttgatattgaaaatgaacaaaatgctaaatttacaccattaagcaaagaaaagtcagagcagttattacaactgtttagcaattattcattagaaagcaagaaaaaaagcattgtagaatctttgtttaatttctctggcaaaaatgctttttatcctattgctgattccgaaattaaaatttatttcagaagaattgttgaacaaatgagccttgctgatatggaaaattgtttgattaaaccagcaatctattttgataagatcaaacagaaaattaaacagctccaagaagactttgctcaagaagaattttttaaatggattgatcaagaacactttcagattaaagcagaatatcaacttccaaaagaaatttatccaaaaagttttgcagattcattaagtcataacctgtatgaaaaagaagcagaaatgaatgactctgagttcaaagctatttctctcttgattagcttggaaaatattatttggtggcatcgaattgatgaaaagcgaaaggattacagtttcaggataaacggttttatcaatcattaccctgacttcttaattttaaccaagaagaatgcactaattttacttgaaataaagggtgaacatcttgctaatcctgaatctaaaagaaaattagaattaggtaaaaaatgggaatctctagcaaatcaaattggtttacctcataaatttagatattttatgacttttttaagagaacctatggaaggagctaaatcattagatgaattgattgaaacgatttccaaactgtaattatttagcgaattccagcttgctttattttgggtttgcaactcatttattaaagtccacgtatttcttgtggcagtatggcattcaaggcaaaacgctttgagccgacctgaaaattcaggtgggcgattttttatgtctggcgtttagctttgagtgccttgtacacacaaggaatacttatggctcattacttactttcaagcaaatctaaaacattatcccttaaacacatcttccgtctaagtgaagatgaagccttccaacttttaaaagcaaaccgttggggcaatcctgataatattcacgatgtttgttgtccgcattgcggtatacgccacaatgcttattttcttcaatctcgtaaacgttggtgttgcaaacattgccaacgtcacttctatattacaactaatacggcatttgcttttcataaattaccatttgttgatattttggcagccattcttctctttgcgaatgaagtcaaagggatttcagcaataacaatgagccgtcaccttaatattagttataaaacggcttttgtcctttgccataaactgcgtgaagccttattcaaaactcgtgatttaacgccattacaaggggaaattcacgaagatggtgcgtggattaatttcaaattacgtccaattaacttcgctaaaaacgcctataaacagaaacaaaaagccgataaaaaaggacggaagtttctaaaattcagaccgactaaacgctgtatcatcagcttaaatcaacgtgcttctaatgatgaaacattatggggttcaagtcgtactattgtggcaatggactatactgaaaatgccaaaacaattttggcattaaaccatcaattcgtgaaacaaggcagtgatattatgtgtgatgaaaatccagcctataaaggtttagattttcattacactcgttggagtgttaatcacgatttatgttacagtgcaaaaggcatcaataacaatctcgccgaatcctttaacgctcgtttccgtgatttacatcgtggtgtacatcacaaatgcgataacaaatacgccctacattatgccaaccaagcggcgtttatgtcagataatcgccaaaagtctaatggtgagctgtttagtgatattctaaaacgttgtttatgggtattaccattaagggaatgggtaggttactggcaagggaatcatcgcacgctagagcttatcggtatgaccgcatttagccccgaagaaatttcccagtcctacttcaaaaatctcaatgaaagaatgaagtacgagcaagagttactggctgcctaatttgcttaactaaaaaacgaattgaaatgtaagtacagagaaatcagcttacctttgacaaggttgagcggattggctacgcccattggtgggaaaatttacatcgcaagccaataatattggcaaacaagtgggaaaatcagctaaaatttacaaaaagaaatgcccttaacaattaagggcatcaaaatttttactgcggttgagattgcattttaggttttgtgcaactgctacataataccggtactataagattttaagccatttttagtggccattttgtatactatgctattttaggagtaatagacttttcttataaaaacgacttcattggggtatagtagacaaatttgttgctaaaacatttgcacaatacgatccagttcaaccttagctgcttcaactgctttagctgcaacttcaggaccataaccgataccttctgcatacacaaactcaacatcagtaataccaataaagtttaacaccgtttgcatatacattttagctaagtccgcaggaccatctttataaataccgccgtgagcaagcactaccactgcttttttacctttgattaaaccttcaggaccattcgctgtatagcggaaagtcacacctgcacggtttaagtaatcaatataagttttaagttgtgcagggatacctaagttgtacattggtacggcaaatacaagcacatcactgttattcacttcaccaatcaatttgttagataaatcaagtgctgcacgttgagcatcattttgcggttcatcacgtgtacctgatgccgcatttaaatcataataaggaagtggatttaccccaaaatcgtgttcagtcacgttcgctgtgattttagatttaaggtaatcaactaatttgtttgaagtggaattatcggcaagaatacttgatttgatcactaatacatttttcattaaaaactccggatatcgaaaatacgattgaataactgtgttagtttatctgaatataaaaagaaataaagtagagaaaagtgaaaagagtgtttattaaaatgaaataatatatcaatttgcaaaatattaaattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttctttttttgcttgtgcttttttagccatatttacctcagatttaagatttataaagggtgggaagctccccaccccacaataactactcaacaatttgagcgctcacggctacttttaatacgccttttaacggattgcttgtaccattaatcacatcggcttcaaatagctgacgagctttgtactcaagtgacggcggaacaaggatcacacttggacggatattcaagagcttgtcaccatcgccttttaacatacgcatcttcgccaacacatccatcaccacatcagcggttaagtcagacgattccactcggtgaatcagttgccagaaaccaaaaccagcattaccacgagcacgcacaccccacaaatacacatcttccataaagactttgtcggatttagacggatcaaacttcgcttcaatttcaggcttagtgcgttcttgccaaatcaacggcttaatcgcattagtatcatctaaaatataaaatgcaggtttgcctgatgctgagccagtggtgacattactttgctgtttcgccacgccagtaccgtccacattcggataaacagggtggtcagtgtcaaaaaagttctgcccgtcataacaaagggtcgatttaccttttttaagcaacccaaacaccaaatcatcaggtaactccgccgcactttgtcctgcttgttgtaccactggcgtaaataatcccacttggtcatcttcgatttcagtgcgtttaataccaaccgtcgattcaaataatttgttctcaatggtcatcccttgagcttgcatcttctggatttgacgctcacccacccattcacgcattttcgggaatgcacctaaccaaccataagtattagtcgcagttgatgatgcaatacgcattgccaacatttcccattgtggtttaattaagtttaaacctgctttaaactctgttttaaatgccgtatctaacgcatttaacaattctgattttttaaatttatccattacgcacctgcctttttatatttttcaacgtactcttcaggggttaaacctaacgcttttgcccctgccatctctgcggctgacaacgccactttctgcgtctgctcattcggatctttacctcccgactgcgtaccagcaagggcagggttaggcgacaccgttgccaaataatctgataacgccaccagattttctttacctaatttttccgcccacgctttctgtgcaggcaacaaacgtccatcagataatgcagattgaattaacgcatcacgttctttatcgttcatttgctgtttaatctggttaagctcagtttgcaccgcttgcaaatcgcttaacgccacaaattttgcaggatcgggattgtttaccttcgccgttaaagccaccacttgcccctgttctttggcaagttcggcatacacatcacttaatgccacttggctgtcgcctttcgctgccgacaatgccgtcagcttagttgtaatttcatcgtccgttgcttgagccgacaagccaaacaacttaatcaaaagttctttcattttggttttatcctcgttaggttctaaaaagtgagaaaactgagcagacattgcgaccgcttccgccaaattgtgtaatgcagggcggttggttaaagccgcatttaacaccttaatcaccgtacccgacgcatctgccaagaacagcggtgaaatatagcgataaaccccatctttaatttcagtagccgccttagatgtccaacgcacatcagcaaacaagccttcgcctgaaatatattccgctctcacaatccagcctgccgcaggattgcctttaccattttctgcaataaagagagtttgatgctcataatcaatcatcagctcaatgcctaactgattgatctcatctgctaattgatagccgttagaatctcctacataaaacgccccctcacgtccatcttgcggatggaaccaaccaaacggaaaaagctgaatacgcccattgacctctttggcaagttcaaaactgcaagctatcggattaagtttgaatttacgcttcacaacgcacctcatacaaaacattgaggctagagaataagagataagagaaaaggaaaaacgaggaacaacttccacactaaagggaatttgcaaatttttgaaaaaaagtgaccgcttgtatagcgaaagagatacaacccattttaaaacgttttaaaaccgttttaaattgttttaaaaaatttcggacgataaatcataccaactaaaacaaaatcgtcactatgggcgatttaggggcattttagacatcattttaaaatcgactgccaatagtcctgaacatcttgcaaaatatcttcctcgtcctgcggtgtcagcattaaaaacggacgggcaggaatttcgactttatcagtcatcacccagcgatcaccaattttaaagacaaggtatttaccttttttaggggtaattacgccgccgaactgatgaatagcggcataggcttcatttgttcccacaatcgctttatcattatcagagacctgttggatactcccttttaaattacccgaatcgtttaaaggtatgccactacggtggtgtattcccgcccaagatggacgaccaccagcttcaaaattatcaagcactgctttccgcattgtgcctgcaatatcacgcattaatggctcacgatggcgagtaacttttgccatctcgcttaatatggcaagaattttatcggagttgttgatttttaattcaagcattgttatagtccttacattaaaagccgttagaaaagcgatgaatctcgacgatcgcaagcgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctaatgggacgttaattgtaggtggtgcagattattctaccccaccagtagcaaccctctatgttagagccaatgatagcagtcgcaataattttaatgaagcaagtttgacctttgatgtgtcgcaaagctattcggaagtgacgtttttaggacagaagcacggccgtgatagcgatagtgcaaaacacgattttaagtgggtttataaaaatcctgagttgcagatttataaacctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgtggaggtaattaatgagtgtggtcattaaccaagtggcaaatgccaatgtctatatcaacggcaatagctttttaggtcgagcaaaatccattaaaacaccggagtttgaagtggagtttgctgagcacgataaccttggcttaattggcaaattgaaactgccgaataaagtcaatgcgttggaaggggaaattgtttgggacggcttttatctggaagtggttgctttggcttacaatccatttaaagcacaccagttaatggtgcgtgccaatgtacaagcgtttaactcaataggtatggcaaccgaagtgccgcttgtgatgacaatgacggtggcattcagtaaagtgaacgtgggcgaatataaaaaagagccgaccgaatatgcgatgacttaccaaatcaataacatcaagcaagtgattgatggcaaagaagtgctgtactacgatgcctatagcaacaaatataatgttgcagggcaagatattttacagaaataccgcactaacatcgggcagtaaatctttaaagtagtttaaaatcaacccgtagccaaaaaccgtaaactccttagtgaagttaaacaataccactaaggagtttttatgcccaaatcaaatgaagcagtgactacacttaaaaatttgcgtgtttataccactcacaaattgaaatatccaatcactaagccggatggtgaagtactgaatgaaatcaacctacgccgtatcaaaggctcagatttagaagcttttgaaaataagaatttcaatccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacatttgaccttgatgtttgtgcaagctcgcacaatgcaaaatgcaagaggtacattaccgccgagcaggaaaagtatccgtatgcaacacacgataatcaccgccttctactctcggcggtgcattaaaaaatccaactctttaaaatcgtaccctgttttaacgtccttttgtaacagcaacatataacggctctcaatattaccgctcacacgttcaaacaaaggtgcttcgtcccatttttcccgttttttccagctggcgatagtggacacaggaatgttaagcattttggcaatttccgtgagtgaatagccagcccaatactttaattgtgcttcacggtgggtattcatattaattaaagcggtcttttccgcttggtttgttgcaatatccgtcattgttttgcgtcatcgttgaaaatatggctattgttatgaaacggacggcgtttgtagaacagtcccctttgttaaatcctgcttaacaaccgcaacgctttgcacctgtttgaaaatccaatcaccatatcggcaattttgaacattctcatttcgaggaagcatttatgccgaaaaaatccaactggtttgtggtagccacagaaggagcaacggtggacggtcgtcagatcgaacgccagtggctttctgatattgccgaaacgtacgacccgaaaacctacggcgctcgtatcaaccttgaacattttcacttgttttggttcgaccctgaacttgcccattcaaaatgctacggtgatgtgttagccgttaaggcagaagagaatgacgaaggcaaattacagctttatgcacaaattgagccaacggatgaattagtcgagttagtgaagagtaagcagaaggtttacacctcaatcgaagtccgcaccaattttgccaaaacaggcaaagcctatttgacaggtttagcggtgactgacacgccagcaagcttaggcacccaatatctctctttcacaacgaaaaatggtgaacagcaaggcgaaatctttaccactgaagcggtggaatgttcgcttacctttgcagaagagccagtgtcattctttgaaaaaatgaaagcgatgtttagtaaagaaaaagctgacacagcccaacataaagccgacgttgaagctcgttttgctgaacatgaacaggcacagttgcttttagcggaaaaatttacagagctagaagagaagctaaaacaagccgaagcggaaaaagtcgcattgcgtgcagattttgaaaaattatccgccgatctcaccgctttacaaagccgtgttgatgttatcggcagtgagccagaacacggctacacgccacgccctgaaattacgggtggtgaattaaataatgaacgtgttttctaaaaaggacagaatatgagaccagaaacagcgaccaaatttaacacttaccttgcaggtgtagcacaagacaacggtgtggattacaaccacatttttacgggtaaaaatttcgtttcttctaacgatgatttcgttgtcgaaaattatgcacaagtcgcattgttgaaaaacattagtatgctcgcttcacctgatactactggagtaggcggttaatgcgaccaactcaagcccactatttgcgagtaactgcggagcttgctcaatcttctgagcaagctcaactagaaaacctcgacgaatacgaaaaaatgctttatttgctggcccgtcataaaaaagacctgaaagccattgcctcaatggaacagcgagccagttataaaaaaagcattctgcaccactatttgccgtggattgaaggggcattgagtgcgggcaacggcaaacaggacaatgtactgatgacgtggcaagtatggtcggtggattgtggtgagtatcatcttgctttacaaattgccgattacgccattcatcaagacctaacattgcctgacggctttagtcgttcgctttgctcaatgcttgctgaagagtttgctgacgctgcgaaaaaagcccagaaggtgcaaaagccgtttgaagtgagctacttgttacgagtggacgaactcaccaaagagaaagatatgccagacgaaagtcgagcaaggctctaccgtgaaatcggcttgctacttgaaacgacacaacctgaaacggcactcagctacttagaacgggcattagaactgaatttaaacatcggtgtgcaaggcagtgttaaaaaacttcggaagcagttaaaccaagccgacaccgaataaacagagcaaaccacgcagccgacggggcgtaataatggggattttattcggcttgtttaccctattgatgaattggtactacaaagaccgagaaatcaaactgaaagaaaaagcccttgagcgttataaaatcaacttaaaggacattttagacgatgaacaaaaatcttaaattcggcggagcgatggtctgcggtatcggtgcgattatcggcttagtacagcttaatcaccctgaaatccgcaccagtccaaaaggcttagacattatcggcaacactgaagggtgcagacgagatccttatgtttgccctgcgaatatactcaccgtcggcattggctcgaccgaagccacaagcggtaagattgaacgcaaaatttacagcgacaaagaaattgctgaccgctgggcaaaagatttagccgaagcggaacggtgcgtaaaccgctacgccaacggcaaaaaaatgccacaaggggcgtttgatgctttgacatctattaccttcaatgcaggttgtggaacaatgcgacattcgaccttgttcaaactcgccaatcaaggttacagccctgcaatgtgtgaacagtttagtcgttgggtttatgccaatggcaaaaaactgcgtggcttagaaatccgacgtgaaaaggaaaaagcattatgtttagcattataagcggtatgattgagaaaagttttggcaaagcgatgattatcgccttgctgattggtgtctgcattaatgcctttctctgttatgaacgcaaaacactgcaggcggacaaccaatccaaacaagaagaaattgctttagtgcgagcggataaccaaagcctagccaaccagctagaacaggcaaaccaacatattctgcagtatcaaaagcaggtggataaattacatcaacaagttttaactaagctcacccaagcggagaaacgcaccaatgaaattttacttgaactggaaaacaattcatcttggagctatcagcctgtgcctactgacgttagtcggttgctcaaccaaagaagcgatacagtatcgaacagtaaagccaattccgctcctttgcccccaaataaagcagtgccacagccccaagttcgagataaaaaccaacgctgatcttgcaaaatctctcgaccaaagtttaacgaccattgagctttgtcaggttgaaattcaaggctgggaagcgtgtgtggaaggttataataaacgtattacagaataatgattgccccgactagtcggggctttttattgacagatgaaaataaaaagccgacaatgcaaaatatattgtacgttttctatgtaatggaggggcaatatgaataaaaatgcaccttatattcgtgaaattgttgatcgcacaaaacaagtcggtggcacacgaattgtcggtaaaaccaaagaagaaattcaaaaaaatgctctgttggtactacaacagcaattaaaacaatcaaatcaaaatgttagaacgcaaagtcccgaccaatcaaggcttttggtcgtaaattgacaattttcttattcaacgttaggatccaactattccctttacaaagcggagaaaaacaatgattattttacaagctcaacctatggcgcaagtgccgcataatgcagtatttgcagtggttgaaacacaccaaaagccattgcgtgaagtgccagcactcagcccacaagaatataaagtgtttgcgaatgttgaacgttatgcacagcaaatgacagaagaaagtctaatgcgagcaatggtgctgattaaatgaatgttgcatatacgcaactcttcaatatggcattttccgatgaagaagataaacaattctttattgaacagtttaaatattggaaacaaaatggcgaaaatagtagctatcattttggcaaagatgggttttatacccctattcaatcaggattaagacacgttcatcttgttcccgttattaatatccttgataaaataaattgggataaacattggcaaacagggcaacgccgaacgagtgatacttgtcttgtgtatgttgaagatggctcagattatttacttattaccattttacctgaaccattagcccataaaattgcagctcaacgagaagaaaatcatcgtgtaataatgaaacatttccgacacattgcagaacaatttttctattatcgaaatattgtcagttaaataaagcgacactagtcgcttttttgttacccccaaatccacacccacaaccattcgccccacctttgctacttactcacaatatcgctatttaactcaacgagaaaaagcgatgaaagaccaaattgaccgagccaatgagcttgccgaaaaagaaagagagcttgcccttgcaaaacttcgcaacaaaccgaccgcttgtagcctgacccattgcgaagattgcgacgaaccaattcccgaagcccgtcgccaaaacgtgcaaggttgcacccgttgcattgattgccaacaaatttatgaatacaaacaaaaaggctatcgcaaatgattaaaccagacaaattgcgtgacctgctcaccaaaaccattccttattttgcgaaaaaacctgagcaattacagatttactatgccaacggcaaaatctgggcgacaggggcgacatcacttagctaccaatatctctacgacttagaaattgtggtggaagatttccctgaacaccctgatttactgtttgtgcctgtgatggaatttatccgcttgcaacaatcggagctgatgaccaatcccaacaaacaggacagtatcacctttgaaattgacccaaacaacaacgccacccacgatatttacatcaaaatcccactgaccgagcgtgttattgtcaaacaagaaggcgatcattaccaagttcaccacgccgaagagccacagccgaccgaatggcaacctctggaacggctgactattttgtgaaaggggaacaggtgtatgagcgaatgggagcgatggaataatggcgacagacgacattatcaaagttaaatcagcgtttaatgcgttgctcaaaaatatcagcaaaccacggcgacggttgctatatcaacaaatcgggcgtgaattggctcgtagccaacgcagacgtattaccgcacagcaaaatcctgacggctcgtcgtacacgccacgcaaagtacaacgtaagaaacgcaagggaaagattaaacaaaatgcaatgttcttaaaattgaagtcagcccgatttatgaagttaagaaccgctggggataatatcgagttgggttacagtggcagtgacgcacatattgcacaaattcaccagtacgggttaaaaggtcgagtggtgagaagtgcaaattggaaggtgaaatacgatcagcgtgagttgttaggctttaccgatgaagatattgaaatgattgaaaattttgtgattaaggcgttggcaggacagtaaaaaaggcggttagaccgccttagagtgatatttttcaatgagtttttcattatctttatatttaatgccttttttagcgagatcatcttttacaacttcatcatcggctgcaaaccacgccacaataaagaaaatgataaatccaactaatacaacaacaaagccagtagttggtagtaaaaagtagagagataccaaaataagagcaagagataatccaataaaatttgagaaaaaactcagtatggcaaccaaaatcgttcctagagttgtcatcgctcctaaagcgattgaaattcccaaacctaagaaagcaccaaaacaaattaatgctattggaataagtaatagttccataaacgcccccttgtttttgtgaattattgagcgaaaacggatctattgtcaataaaaagagaaaaaatgatgagcaatttgaaattagaagtgttgttaagtgcgatcgataaactttctgccccttttaaaaatgcaagtaagcaggcggaaaagctatcagccaccttaaaagcaagtaaagatgccgtgcgtgagttggaaaaggtgcaaggcaaaatcggcacatttaaaacaatgcaaaccaatcttcaaaaagcgagtgaaaccattcagaaaactacaaataaagttggtgatctgacaggtaaacttgagaagatgaaaaagcagaaggttgatttaaaaatccaaattcaggcagaaaagagaaattatcaaaaattaatttcaggggaggactttctgaaaaaacattgcaagtggatcgtaatatcgcaaaaatgcaacgggaatatgaaaaattaactcagaatatttctgttacaagtaaaacgctcactaaagaaagtaatatattaaaacaatctcgcactgaaaaagccaaacaacttttaattttccggaaattaaaacaggaattaaaaacaagcggtattcatattaaagatttatctaatagtgaattatcgctagcggaaaaaataaataaagctaatcaagctattgataaacaacggcaagcattagaacgtttaaataaagtcaaacagcgaaatgaaaattatcggcaaaatgtcgataaattaagaaataccagtgaaagcctacaaaatttaggacagcgatcaatggtaagtggtgcgatcttgcttgcccctgtggttggtatgggaaaaagtgttgtaggaatgacacaaacggcaggtaaatttgagcagtttaaaaccatactcgaaacggttgaaggctcaagtgaaaaagctaatcaaagttttgaatgggtaaaacagtttgccgtagatacgccagcgaatttagatgacgcaatggaagcctttgtacgattaaaagcctacggtttagatccaactaacggcttaatgcacaccttatcagatacctccgctgcgatgggtaagccagtaatgcaagcggtggaagccattgctgacgcagtaacgggtgaaaatgaacgtttaaaagaatttggtattaaaggtgccgttgtaaaagggacaaattttattgaatatacctatacagataaggacggaaaacaacaagttgctaaggttgataaaaacaaccgcaaacaaattgaaagtacgttacaagcaatttggaataataaatacaaaggtgctgctgaaaagcaatcaaaaacattattaggcatttggtcaaagttaggcgatgtatggacaaactttcaaatgcaagtaatggaaacaggtgcatttgattggattaaagacaaaattcaaggggttttagataccctagacaaaatgcaacaaaacggcgaattaaaaaaatgggcagaggcattcggttctgtcattatggagatctcacaagggctttgggcatttggtgagaaaatctttgccgcagtgaaatgggtggctgaatttgcacgagaaaataaaggtgctattgcaacctttgtgcaatggtcggcaattttaggttcaggtctgacgattttcggcggtttggcaatggtattaagttttgccttatatcctgttgctcgtttaatttatggtttcgggcatttaagtggcatcacaaccttatttaataaagtattatttgataatcataaaaaatgtagattagcaaataaagctctatatcaatattcaaccaccacgagttatgcaaaaagtaaatttataacttttaaaaatactgtatctaaagttccgaataaaattcaaaatttgccgacattactacaaattggatttataaagttagaaagtaagttaagacaatttttccctttgcttaaaactaaagtcttttggataaatttagcgaaaggtgcaatatttaaactttgggcagttattaagtttctattttcatcattgaaattattgctcggcattttttcaccaattggattagcgattacagcaatatctcttgctggtatcgccttgtataataattgggaaaaagtcaaagcctttttcggtggattttgggagggattaaaacaagggcttgcaccagtgcttgaaaaattcacaccacttggagatttatttggtgtcgtttgtggttggattgaaaaggcggtgaagtggattggtgactttttcgcaccggcaaacgaaagtgcggaaagcctcaataaagcggcagaagcaggtaaaagttttggtgaaatcgtggctaaagggattgaattagcacttacgccattaatgttaatgatagatgcgtttaaatggattgttgataatgttcaaaaaattgcatcaagtattgttactcctgaacacgccaaacaaattgaaaatactgccaatatggcaaatatgatgtacgacccgaattatgatccaagctctaacaatgtgccaaataaaccaaaatggtcaggtggttatgctggtaacggtggtaagtttgaaccaaaagggatttatcacggcggcgagtacattatgaccaaagaagccacaagccgaattggtgtggcgaatctcaaccgcttaaattacggcggtattgcaggtatggctgctttagcttctacggtagcactggcacaacctatgcctgtggtaaaagtggataaccgtccgctgattgccccaacgcaaatccaacggcaagccccaccgcctgttaatcagtcggtcaatatcaccgtcaatgcaaccgcagggcagagtgctgaagagattgctcgccttgtcgcacgagagcttgaaaagcaacaacgcaacgcccaagcgaaagcacgcagtcgatattgggataagtgacccagtacccagtttgtgacccagttgaaaagccccgaacaatcggggtttttacttgcagaatacagcaagttaaactatgatccgcctgaaataacgaggtggctatgaaaaaatcatttacagaaaaggcaaaatcattgaagggcgtaagtcttgcaatgggcatttttacatctttttttagtcaagacacgcaagcgacacaacaaaatgatgtgcaaaatctaatgcaacaggtcaaacaaacatctcaaattcttgttcaccaaaatgttgatgaaaggtatttcttttccgtgttgtctcaattgaatgaaactatcgctctattaaatgatgtggttcgttcaatgtcaaaacctgaaaaagttatcaatgatcttatttttattgatacaggattaaattcattagctcaaatggttcgtcagaaatatattgaatttttaagaaataatatttcggaacgcactatctttaaacattttacggctgaagtttttaaattcagtgtatttactgaaaaaatgcgtgaaaaaacaaatcattattccattgtgccaagtaaatcaaattttactcaggctgatttagatgaattggtgacaaaatacaatggttgagatttatcttagtccatttgttattatgaccgatggtttagccaaattaattaatgatttaatgttattagaacagtcaatggggcattttcgtcccgatactattggaaactggggagcatttgaagaaaatccgcgcgcgatgttagcattagtaaaaaaggtacacgtagccgtatctaatgaagattttgaacgatggaaaaagaaaacaggtcaaaatcgtaaaagtgataattatctcatttatactaaacacgaattagaagagaatacttttcttatcttagattttattactcctgatgctcatcaaaaaataaaatcaaagctatctgatattgttttatttgcggaaatttttcaaaattgtcactcagcaaaaatagccgaacattttagacggtttgaagagataaaataaatctcgatttcttaaataaatattgtttaaacccaagcgacttcggtcgctttttgttacccccaaatccacacccacaaccattcgccctttgtacttacctttcgcacaatatccccatttttaactgacggatttttattgtgcatcacgatctatcccttgtgtatcaagcacgcaccgatattgtgaatgtgtgcaaatgtgtgcagttgatgtgtgcagttgatgtgtgcaaatgtgtgcaattaattttagaacagatcaaaatcgatcaggaaatgactgttttttataaaaaacagggggtagaaaacgtggtttttagtgtgtaattagttatcaaatactatgtaagtatttgtttttatgggaattttataaaataaaagcagaaatgggaaatttctgctttagggaaaatggtgcaacagtccaacttcgtcttaacgcccctgtatcaacaggcgatttcgcttgcactttcgcaaaagcctctaacgccactttacgaataactaagtttttccgttgctcaatctgctcaatttgttgctgaatttgtgcaataaaactactcattgttttctcccttggcattgataaagcattgctacactagcaggttttatcggctgaacggcaataatgctccacacctcgccattcacttcaaccgctgagccgacttctgctttttctgtcagataaatcaccacgtcgccttgctgtaccgttgcaaattctcggtttactgaaaaatcataagccagattatcaaaaagacagtaagcattctgtttactgatttcagtttgcatttttcccgtggctggatcgtattgcccggatatttgtgttttaatcacacaaggcgaaccaaacttctgaattaactgcttggagatttgctttagtttaccgtacaagttacccccttaacaaggacacattgttagtagatgatgaatttaaaaagcgagaaagcaaggttttgacatactcaaaccgattgctgctaccactgataaccgcttgattttcgtaattgacagaaacagggcccacttttacgcttgccatcttctgctctgtgttctgatttagatctgattgcaatgctaattcgcaaaccgcatatttcacttgtaacggaatttcgctactctcttgactactttcttgacgtggaaattgtctgatttgcgtaggatctgctttctctcccacaaaacgataattatgatcgagaaaatctgatgcactgactaagcgccgagctttttgttcatcatcaagttcattccacgcctcaaaactggccctcaattgatggtagccatttgcctcttcaagggaaacataactatccgttggtacgttcagggtcattgtcgccccctttcgcttgctttaataacgcaatcagctcatctttcttcgctccttgtggaatttccacatttaaggctttaagtgcggtggttaattctggcacggtcatcttgtctaatggttttttatcagattgttcatcaacccattgaaccttaacccctaaggattgatacgcttgtgcaatcttaggaaaatccccataaatcaccacatcggtcaccttactttctgctttttcaaaatacagcggatttcggtaatgtttatgcggttcaaatcctgtggtttgcgttgtataaattaattgcattgattactccttctcaacataaaaagcggtacgattttgttaattttttgcaaaaacgcaccgcttttatattcacttaacttagttagcttaattcaattaacacgccagccgtatttttattgctggtcgcatatttttgccaacttgcttccgtgccaatggtcgaaaggttagggttcgctcccgcactttctttgtacgaataacctaaaacatcaaggttaaatgttccttccgcacgaataccaatcgctaagttttcttcactgttaatgtcataagctcggaaacccggtaattgcgaattcgtgatagtaattgctccggcttgtaagcctaaaatggtgttagctttggctttatccgttactaacacaggcttgcccattgttgccggtaaaccgccataaataatctggtcttccgattcaaatactttatttgtaattgcatcatcaatcagatcaaaatagacagcagagtccatcacccataaaccaattcgcccaaatttatccccaaacttacgcatccctttggtcaatacttttttgtgatcggttgcaatagacgccgaggctttcatatcaccattcgtcccaattgccgcgattgcaccagcagtcaggtatttaaaataaccgtctaataatgcatccgcatagtcttggccaataaggatagaaaactcctccgtgcttctcgctcggcgtttcattgcctcttccgtaattgcataagggccgtatttaaacggaattttcacgccaaccatttcacccatcgcaatggttttattctcaaccgcgccattactatttacatcacgatgttccaaagaaccaccgattttgtaaaaagattgtttgcgaaaatcgccttggatattctcatcttgcaataaaatgcagccgtttgaagcagcattaaatacattaagattatcttgaatacgctctaaatatgcagtttgagccagttcattgtagataatcacatctttgtttaagcctgttgccataatgttttcctttattctttaggtagattaagatatgcctcacgaccgtgttcctgaataaacttgttcatctcttcaggggtcatttggctacgtttaaattgtttgccagcgggagagccagcaccaccgccaccaccgcttgagccagagccttttagaatagaatctttgttagggtaagcatccactaaagcctctaacgcctcttcaaaatccgcacgttgccctggtttcactcgactgaaaatttcgttgccaagcgcatcttttgccaaaattgcaccgttttcatcaatgctaaaatgcttaccaaagaacgcttgagccacatcaacaggcattgccaatttctctgtgacaaacttagagcgagcgaatgagccgccaattaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaacttcaagaaaatgcttgcagcattcgaacaaaccgcagcattacgtcgcacagtaacaattgaagatgtaggtaactcagctgcattcttatgttctgatcttgcttcaggcgtaacaggtgaagtgttacacgttgatgcaggctttagcattactgcaatgggcgaattaggcgaagagtaattgctttttaaattgatgcataagggcaggttttattcctgccctttgtctactatgcctttttaaatactaatacttttccatttatcaaaacccaatccgtcttgccactttcccttgtttaatctcacactctgccttaatcgcctttaaccactcatcaacattctcaaagggtgcaaaacgatgtcggcgagcgactgcggcaaaatcaccaggggtcagatttcttaattgagcaatgcgatcttgttcaacatcagttaaatcaggcaagctcaatttattgacttgttcttgagcaaatttaaccgcttgctctggcttgagataatcaaaatgcaatttgagatcaaaacggcgtaaagcagcaggatcaagcccgtccattaaattcgttgagaccaccaatagcccttcaaatttctcaatttgggtcagcatttcattgacttggctatgttcccaactacgttgcccactttcacgggcaaacaagaaagtatctacttcatcaaagaccaacaccatattattttctttggcttgtgcaaaggcttgagcaattttttctctgttccacctacatatttatccaacaaatctgaaccttggcaaatcaatactgacattcccaactcttgccctaaccaattcgcccaagctgttttgcccgttcctggtggaccataacaacaaattctaccccgtttagtccgctttaatccttcagtaattttatgaatatcatcattgcaagcgacccaatctaagttgtagctaattttcccttccacaagcggttcgattttcttaaaaccttgcgatttcaacatttgattaaaccaatttaacgttttttcggcaaaatcctgttgagaacaatcagaatacgcctgtttcatcaccgtcaatccacgcgtaattatcgcaggcgacaaggcttttacttgtgaaaaatggcgaatgtaatcgtgagataactgttcattgacaatagaacgaattaacttttctttatgactaaatggcaaatcaggcatttcgaacacaagatcaaaacggcgtaaataagcgttatcaatacaactgaccgaatttgacagccagatcatcggtacatcattattttccaaaaattgatttacccacgccttgttctcctgtgccacagagcgttccataaaactgctggcaaacacatcttcgatttcatcaaaaataatgaccgcacttttatctcgcaataaacgttgagctaaacggcaattttctaaccgtctttttccaccaagtacatcatcatcttcatccatatatgccatcgtataacttgatacattcaatgcttcgctcaataaccctgcaagctcggttttccctgttcctggcgaaccataattaaaatgttcgtcctttttttagcgttatcaatgctaaatttcaaatgagaaagcattaattcataggttgatttaatatgctcaaagtgagaaagagaaaggctcggcttttcagttggtaaagtgcaacgagccaataacatctcttccgttaaaggttgagttaaaaagtcgtcaaagtctaatgtatctccccaccccaaatactcttctaatcgatcagggctatgagaaaactccattaatccataagcaaataatttctgttttttgctgaaaacctttcttacatcatctttactcaacgataaaatatccgcaacaatttcaatagcttggcttaaattgatattaggaagatagcrmgccaaatctttcatctgtttttccgctctcaaatggaaaacaaaacgaaaaatggtcttttctgcttcatttagctctacaatctcacttaatttttcaatattttgatacgccattttccaacgatctgaaatatcttcggaaaaattcgtttccttataacgagcctgtaaaagctccttgacaagcaatcttagattgtcgatattttccatttctggcggtaagcctaatgcggttgcaatatcatcatctcgccaacaactttctctaaaaatttcagaaaagcatttatgctcaaataagagtttcaacattaaatgctcagcatacgctgaaaccgtaggtgggtttaattgatattgattgctcataaaactatctcctatcctatttcacaatagtattttattgagtatagcgacaagatgtgtcgcacagttttatggtataaatcaaagtcggaccggtaagatatgaatatggaaatgaaacgtaagaattcaaaaggaactaagaagtttttgtgaaaatttacaaaaacgaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaggtaatgaaggaaatcaagagcctccaacgcctcctgcgactgatgatgacgaaatgggcggtaatccagatgatgaaccaccagcacaagacgatgatgaggataagttagacaagctcttatccttagttgaaagtcttgtttctcgtgtggaagcgttagagggtaattcgaaatcagaagatgaagatgataaccaagaagagccacaagagaagcctaaagttggtgatgaagaagagaaaggtgctcaggcaatggatatggcggaagtgacacgacaagttacaaaacgcttaaacgagcgtgattcgatgtacaaaaaagtttctctacatacaggagcttttgatgtatctgcaatggattctgctgaggcagttgcagcgtatgcgtgtaagaagttaaaccttaaaacagcaaaaggtttagaggttgcaacaattacaggttatatggcaaatcgtgagcctgcaaacaaacagcgtattgtttcaggtatggataaatcagacgtagttaagggtaaaaacttcttaactggtcaaatcaataaataaggtggtaattaatggcttttcaacaaaacgtaaacattgaaatgggttttggtgtacctggcgacattcacacagacggcccaacacgaacagaatccttggtggttaattctgaaggtgctcaattaaatcttgtgggtagagcgttcacaaaagatgctagcaaaaatgtagctaaagttggtggtgcgattgaaagtggtcgagtttttgcaggtatcttagtgaactcaaaggcttatgctttaacaggattatctggcaatccattagcaccaacgctagcggtggcagataacactcaagccgatttcttaacgatgggcgatgtcgttgttcaggtttctacgccttgcaaaattggtgatttagttgcttacgataccactacaggcgaattatcaacagttgctgttggtggttctgcttctggtggtaaagcattaattcctaatgcgacggtttatcgcttccctgtaacctctggaagtggcggtttaaccgttattcgtcttacaaactaacaaataaaaggacagaataaatgacaaaaaaatcaactcaacacggttttatttctggccgtgcttatgctaaagcattacaagagcaacgttctgcaatcactatggatgcggcagatgttgcacaatatgcagcattaaaaaacattggtattggcttttctgatgcatttttaagccaagcaaatgttgcttatggtatggacgatgttcagggtggggtaactgctggctcgacaggctctcctatccagttcttgcaagcatggttaccaagttttgtgcatgtagcaaccgcacctcgtcagatcgatatcttgactggtatttctacagtaggcgaatggcacgatgaagaagtggtgcaaccgattttagaaatgaccggtaaggcagttccttatggtgatacaacaccagtgccattagtagggtacaaccttaactatgaacgccgtacaattcaacgttttgaggcaggttttgcagtaggttctttagaatctgctcgtggtgctgctgctcgtttagatgcggcaaataccaaacgtgcttctgcaatgttggcgttaaatatcattcgtaatgatgtcggtttctatggttacaatgatggcaactctcgtacttatggtttcttaaacgatccgtctttaccagcatacaaaacagtagctcaaggtaaatcaggttctacgaaatggaatcagaagacctttgaagaaatcacaggcgatcttacaaccgcatttactcaattagttgcccaatcaaaaggattaattgatgcaatcaacacgccaacaacattggctcttcctgcgggtcatgaagtcattttaaataccgtcaatgcgttcggtatgagcgtgaaaaaatggctcaaggataattaccctaactgccgaactgaaaccgcacctcaattaactggtgcaaatggcggcgtagattcattctacttatacgctgaagaaatcgtaggtgatacatcagatgatgatcgtcgtgtttggattcaagctgttccagctcaatttatggcattaggtgtcgatccgcaagggaagcgtaccgtagaggacaacacaaatgcaacagctggcgtaatgtgtaaacgtccttacgcagtatatcgtgcatcaggtatttaaccttaaccactcaagcccagttaattctgggctttaatttttaaaaacgagaggaaacaacaaatgaattacgtttacagcactttgacttgtgataacgcatatacggtctatgaaaaaacaacagggggcttaactatccctaaaaccgaagtgattattcacggcggaacaggattggcaaataaacatctgattacaccgcttggtacggttacaaaagtaagtgatgatgaacttgcgatgttaaaaacaaacccagtatttattgaacacgttaaaaatggctttctaatcgtccaagaaggcggtaaagctgacgatgcggaaaaagtagcaagtgatatggcggtagatactggtagcgcaccactaacagagcaagatgccgaaaatacgggtgtaaaaaaagcgaaaaaaggtaaataaagatggatattgctacgttcagaaaaatgtttcctgcttattctgatagtcaaacttttagcaatgagatgatcgaaatgtggctggacgtagcaaatgttcatctcaaaaaaggctggtcgttaagtggtaaaacctacgaacatgccattatgttgatgttggctcatcttcttcatagtgttgcgaaaacttcaagcggtaatgctgaatcaggacctgctggaattgtgacatctgcgacagaggggagtgttagtgtttcttttgcaacacctacgacaaaagatgcgtgggaattctggcttgcatcatcgccttatggattgcaactttgggcattattgcaacagttaggaactggcggtttgtttattggtggtttaccagagcgaagtgcagttcgtaaggttggcggggtgttcttatgagtcgggcggataagtttagaaaggctttgcaagataagatcgacaaattgagtgcagccaacaacaaagtcgcaaaagtcggtattgttgaacatcaacattatgatgataacacgccagtagcttatattgcttcaattcatgaatatggttctcctagcaataacatcccgccacgtccttttatgcgcccaacggtatcagagaaaaaaggtgagtgggcgaagataggtaagcaaattctgcaaaatggtggtgatgtcgatagtatgcttgaaatggttggtttaagggcttcggctgatattgttgaaaaaataagtaatattgatgttcctccactggcaatttctaccaaaaaagcccgtaatcgtaaggctcaccaacaaactgccaaatataacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaagcccatattcattcccgccaccttgaccaactcttttacgagtttcccaaagttgttttttagcttgataaataattccttgcaccgaattcggtaaacaggttaaacttaaaagtaataattctttggctgagtagtgcgtttttaagttgttttcactcataaaagctccttagagcgttctctcagcgaattttttaaggctacgctgagcaaatcgcccagcccaaatttcttcaggcggtacaccgattgcatctgcaatgatttgttcgccttttcgccacggtctatcaagggcattctttaatgtgctggcttggctataaccgtgttgtaatgaaagctggcgtaacgaccaaccagccttatgtaacgcagcaataatgtcggctctatgccagtcttgtgctgttttttttggctctgtcaatgtactcattagataactccatttgtttaacacgagagataataaacctcaaaagaaactaaatcaagtttaaaaagttctttttaaagttaattgattgcattttaatcgtttcttttgaggcttttaatctaaattattgttttaattgttctttttagaactttaaaaacattaaaaaagaaattgggattttttaaagttatgactgaaaagtttaaaaacaaatcaatgattggaaaccgaattagagagcagagagaaaagctcggtttaagtcgaaatgaaatggcagataggcttgatgtatcactatctgcgctacaaaactgggaaatgaatgaacgagagcctcaggcttcaatgatcattaagatagcagaatttttaggggtagcacctaactacctactaacaggtgaacaaagccaaccacaagaagcaaaaagcattgtggcacgagcgtttgaagcattagaaaaagaacgtgcagaacaggacgaagttgaaatgctatcaagctttgaaagcattgaagtttcagcaggctttggaagctttaacgtgggcgtaaccgaaccagacgggcaagtaccttacgacagcaaccttctacgcaatctaggcgttaaaccgaagcactgtggcgtattttgggcgaatggctcatcaatgctacccaccattcataacggcgaccagttgttagttgatttcagcaagaaagaagttaaaaataacaaagtatatttagttcaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcagttagctcattttgttgggagggcaatgttaatggcagattatcaaactctgaagcaaattcttgattacattcactattattgctgattactcgataatctttcggactaaatccagccaatgttaaaccttccacaatattacctagcacatttctaaattgggctgatgctgtgaaaacataactcatattaagcaatgggttgctaaacggtttcgcattgggttggcgtaaaatacgccctacaatttgagtaacatcaatttcagaatgtttatttgcaaggttcgctagaatataagcaaaagaacagtcccaaccttcttttaaggcgtttaccgtgatcacaaaacgaactgggcaatcaggcgaaaataaatcaacattttttagttcatctatatcagcagttttgattttgatctgctcggttggaatgtttaattcttcgattaagattttcttaaccttttcaaaagtcgtattatctcctttcgttttcgcttcagcttgaaataatacaatcgggcgaacataaggttcgccattttcaaaggctttttgagcaacttgctctaaatgatgttgaaacgttaccgctgaaatcagtacatcttctttacttgcttgattagatgcattaacaggtagttttaccatattttctttttttaatgctagtgaactgacataagaaatgatattgctttcttttcttggtgtagcggttaaatctaagatgaattttgcatttagattggttagcatttctagcgataaatctgatgtggcattatgactttcgtctacaatcacaacaggttcaaggctgcgaattacattgattagcgaagtatcatcactatcaggcaatgcggtagctttggtatcaaaagaagccaaatagccattttcacgataaattaaacgaccttctttgtttctcgttctaaacgcatcaaaagtcattaccacaatggaaataccgcttttcacggtatctgcatcaaatccacgccctaataaaacatcatctttttcatacacattcacacgcccattaaatagcacatttaatttttgacggtaagggtgatcaggattgcgtaaattccgaatagtctgctctaaaatagccgttgatggcacaagccaaacggtaaatcgtggttgaatttctccgtgaaattcgaccgcactataaattgattgtaaagcattaaccgcaataaaggtctttccgccagcagttggcactttaacgcaaacgtggggcgtattggtaattttctctacatactgttgattaggtacaccttttttcacccaataatttgaaaaggcttgtttcaatttatggctaccatattgatttaattcactcaaatagtcgtttaaatcattaatcacttgtgtttgataactgtttaattccattgcaacacccttatagcttactaatgtctcgcgggattcgtttaaaacggattttaaattgagctaattgctcatccgttaatgtgcatttatccgcatagataacaaaatcttgtggtttttctgccataaaatcggcatttaaactgcgtaaaaaatctaggcttaaggttgttatctgatctgattcgtaataaaaaatatatgctgtttggtaatttaaacctaaaaaataaccgcttgtgtggttatcaaaaacggtttctagtttttcgctatgagcaatatattcacgaatactgattaaatctgcctgattatttaaattgccgtctgaatcaaacaaggtttctccaatggtataaaaactaaatcctccaccagtgcctttttgcgtttctgcttttgaaccgtaaccattaattaccctacggattcgttccgcagtgatattttctgcataatccatcatttcaataccgataaattggcgattgccgccatccttggcgttaagatttaaaactgcgtgggcggttgtgccgctgcccataaagctatctaacacgatagaattaggttttaaaaatgaggaaagcaattcggtagaaaattcattcggtttcggattttcgaaatgaataccaatttctttctgaaatttatcatcgctaccgccaaaggctaaaatagatggggtattttcatataaattttcttttaaaagatatttacttctaggttgcgtaacttcatctgctccaaaaataatttcattattttttaacattttctccattgtaactaatggataacgccaacctttttcaggaataggacactcttttttagttacagggtgaattaatggaataaaatactcatcaggggctttttctttattgggccacgccatagaaacagtttgaaaaatatctccattttcatcaatgaatttataggctttctcgccattagaaaaatcctgttttttaagccaatcctgatattcctgattaacccattctaaatctgcaattaatttattttgttctaaaatttcagtggataaattatattctttgacgacttttttaagattttctgggtattgtttctttccaattttcttaaataacattttcgctttttttaacattgctggggcatttttctttaagcgtttaagtttatgtgttgtatgaaattgatttttaccaaacaatactatgctttcgtgttgataagatattttttgactatcaccttttgggttacgtttatcccaaataattgttccaagatcatttgttttaccaaaaatttcaatcaatatagagtgtaagttggtgtattcattttcatcaatatggataataataactccatcatcagccaatagacgatgtaataattttaaacgtggatacatcatacaaagccatttatcatggcgagataaatcttcaccctctttgcctaccacttcgccaagccattttttgatacgtggatcgtttacattatcgttatagacccatttttcattccctgtgttataaggcggatcgatataaatacagttaattttgccttcatattttggcaaaaggctttttaacgccaagagattatcgccctgaatcagcatattatttttgctattttcaggtttatcgctattcgctttaaaatcgtattgtttttcaagaagatgaaaaggaacatcgtgatgatggtttttgactttatcttttccaatccaagttagctgtggcatacagcctcctcgaattttttagataaaatagagaaaaaagtattgacaaaagttaaaactcgttcacagttgcgttgcgttgcgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttacctaaccgaaggggaagcggtcgcagatgcgttttattttgcaaatcaagcggaaatggataaaggggcggtagtgtcgtgggaagctcgtcctattcttgctctaatgaaaattcgagcaagggacggacacgctacttttgactccgaatatcaaaacgaccctgtaagcggtgatgatgcgatttttgccaacagcttgcaatactggacggaactgcctgatgacttgatttattttggggcgttagacccatctatggggaaagcaggggcaagccgtgacccgtgtgcgattttggttggggggtatcaccgtgcaagcggtaagttatacgtggtcgaagcccaaattaaaaagcgtttgcctgatttgattattgaagatgtgattaggctacatacgcaataccagtgccataaatggtttgtagaaacggtgcaatttcaggaatttttggcaacggagctggttaaacgctcggcacaacgtggcaagcctgtgccagctatggcggttaagcctaacaccgacaaaatgttgcggattgagagcttacaaccgcatatcgctaacggtttgattttaatccaccgctcgcactctacccttgagagccagcttagacattttccaaaagccgaccacgatgatggccctgatgctttagagatgttgtggcgtaatgcggtaacagcgtctgccccgattgagtgggagtcgatagatgatgaagattgggaatatcggagtaagtggcgacattaatagtgggcaggtagggacacactgcgtgtgtccgtgaaagattaagacaggcggacacacgcagtgtgtccctacattgtaggataatttatgagcaagaaaaagaaaaaacagtatataaaacccgatttaagtggcgttaaaaacccaaatttacaaaccgatttagccgaaatcacggcgacgggacgggtgttatcggaccatccaagcaattttattacccctgcgaagatgaagcagatttttgatgatgcggaaaatggggatattaccgcccagcacgagttatttatggatattgaagagcgtgactcggcgatttttgcgaatattcagactcgtaagcgtgcggcattgggggtggattgggtgatacaagccccacgcaatgcgacacctgcggaagaaaaactgcgtgatgaagtcgatgagttgttttatcagatcggcaatcttgaagacttgattattgactgtatggacgctgtcggtcacggtttttctgctttggaaattgaatgggcatttaatggcaaggtgtggtatccgaatgcgtttatgcaccgtccgcagtcgtggtttaagtgggataaattagacaaccttttgcttaaaacgccacaaaatcaaacgggcgaaccgttacgctcttatgggtgggtggttcatacccataaatctcgctcgacacagttagcacgcaataatttgttccgcacgctggcgtggttgtatatgtttaagcactactctatccacgactttgcggagtttttagagttgtacggaatgccgattcgcattggtaaatacggtgcgggggcaaccaaagacgagaagcaaacgctcaagcgtgcgttagctgaaatcggacataatgcggcaggcattatgcctgagtcgatgagcattgagttgcataatgcggcaaatgctggcggtgcgtcgggcaataatccgtttttgcagatggtcgattggtgtgagaagtctattgctcgcctgattttagggcaaacgctgaccagcggcgcagacggtaaaagctcaacgaatgcccttggcaatgtgcataatgaagtgcgacgggatttgttagtttcagatgtgaagcaattggggcagacatttactcaacagattattttgccgtatttgttgattaatttcccgaatgtcgatcctactcgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagttattggcgagttgcaccaagcccttttgagttgggctggcattgagacttccaatataaaacttaatagcgtctgcaacttgattacttcttcctgcaataggttgcatatttgccaaaagtaatacgttcttaaattcttcaaagtgatcttgaacacgctcttggacctcgtttagccatttagctgttacaatagtccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaacgtcaaggtaattggtgaacctgcagaacgtcgtggattgttatcgcaaattttgatttcttggtttccgatgattatgctgattggtttctgggtgttctatatgcgtcaaatgcaaggcggtggaggtcgtggtgcgatgggctttggtaagagcaaggcaaaaatgattgcccctgatcaaatcaaaacacgtcttactgatgtggcaggttgtgatgaagcaaaagaggaagtcgctgaggttgtggacttcttgcgtgatccaacaaaattccagaaattaggcggacgtattccaaaagggattttgatggtaggtcctcctggtacgggtaaaaccttgttagctaaagcgattgcaggggaagcaaatgtgccgttctttacaatggctggttcagatttcgttgaaatgtttgttggtgtaggtgcttctcgtgtgcgtgatttattcgatcaggcgaagaaaaatgccccttgtattatctttattgatgagattgatgcggtaggtcgtaagcgtggcggtgctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcatcgcaattggtgtattgcttgcatcagatggcattgcttgaacagtaacattatttgaagcaacctcagttaatgttgcaggtgtaccatctgcatttttatatgtatttgttgcaggatcgaaaactttcccttttaagtcactctctttatagaatttaccatcttttccgcgaacaagcgtaactggtacttgtttaccatttacagtttcagtttttacttcgcctgttacagaatctttctcaaagtactcaaacggttttcgatcgttcatttcttttaagcgatcatcgacatagcccgtattcgctgcagccgttctgtctttcgccgtgccgtccggattacgttcaacatcttttaagccagtgatagagcccgtgcctttagcatccgtaccctcaccatttttagcaaagctaatttctggtgctgtgccatctgcccccgaagtaatgcttactgcatctttgccattttcgcctttaagtgccaaggtgttagttgttttaccatcttgaccttctttgctagttaaggtaattgcatctgcaccgtcatttcctttaaccgttacaccatctctgccataagtcgccgctgatttatccgtttgattttcgtctttcggaccaacagtcataccatctgcattgacagtatttttagagtctttatccgttgccgttacgccatctgctttaacggttgttgttaagtcattaccttctgcatctttnnnnnnnnnnnnnnnnnnnnnnnnnnnnnnnnnnnnnnnnnnnnnnnnnnnnnnnnntgtatctttctgaacaatgcttgtaccgtcagcacctgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacttgcggatcgataacgatagcattactaccgccttgtaacctaaaataaggaatgttatgaataacaccgtgggcgtgagccttaccctctccgtcaagctgtgcgaccattggctgaacatctaccgttccaacgggtgcaacgcctgtcgcatttactgctttaacttgaactaaagtaacggtttgtatgcgattgattaaactaccaacaataaaaccaagctcaccaactcccccgctactttgttcttccgtcatttgtccgaatttattttgcaattttcacccccgcatctaatcttgacgcatcaatagcactaaaccatctaccaccagcgatttcactttctaggtaatgcgttaagccatatattcgccactgcccgtttgttgattcaatcaggctattcctaatctctatttgcccgttatgtttgattaacggatcaaataaacattgcaaactaaccccttgtagtgttggtgttggatagccaattaaaccagtttgaggagagataataggtacttttatattccgtggttgccctcttggagtaatagcgattgtattaacttctaaagtcacagtggcatctactgctttacaaagctctgtaattttctctaatgctgtttggggcaaatatgcgttactcacttttgcagtaacaccactattctcaaaacgcatatccattgatttgcatatttcagagataacgcctgcaacatcaacctcgcctttaaaacttaaaggttttgccggtaaaatttgatgattcattgcggtaacagaatctaccgtcaagataacctcaggcgctgagccatagttaggataagcaaacgtaattgtgccaaaataaacggtcgtgtaagtttgcccaccatcagaacttgcctctaacttgatagaattcagcttttcttgttttatattccacgatattttcgatatacgattcattacattttggcttaaaccataaatcataatcttcgcgttaggttgtatagcaccatttcctgattgtattgtggcagatacccttaaattttctgcaacaatcgtattattcttatcatcaaaattaagccctttctgtccgagtgctatcgttacccttaactttttaacagtaaaactccccatcttaccgctccacaaaaatcaacttatatcttgttcctaacgcttggtaatgtggattttgtttgccttgcgtatcgaaaaaagcaagatttacattgccaatattaagatactccacactaattaaaggcgtgcgatctcggcaaattctgttattcaagatagatttaccatttgcttttaaagatagataaagctcttcattcagccttgtattaagttcaatatcaaagccaacgccaccaacaaccaccgataacgattgattagggatatttttaactggtacttcataaatctttaatgtcatttagtaccacccattgattctttgaacacttctacaacatctccagctaaatctctctttgttccccaaaaggctttttcttctacgcttttagttccttttaaaaggatagaattattcgagccagaagtagaaccaacatcttttgcagaaacttcgccttggttttgcgttggttccgcttgcggagcttctgtttccgtgtattccacttcaacttctcttacttcttgcaagtgtaaattgacttttagcagccttgctccatcgccagcttctcttgcatagtcatacccaataatgttgcaatttgggtaaatggcttcgggcgtgattaccatatataaatccgtgctattcgcaaacgcatcaacaagggctaaaaatgcactccgctctgctacgcccccactcccttttgtcatcatcacatcaacagtataaggctctataaccttgttataagatgcaaaagagcctcgctccaaaggtgcattagaaatcttcgatcttgtttgatacttaacggatttcacgttatcagccagtaataatggtattccgttctggttaaatatgccccaatagttaccaaagaacatatttaccgctaagccaccaccgaattttatggctgcatcaccaatgtttttgggtagcccaggaacacttggcacaccgattgagttccacatattttctccaataaaaaaacccgaccatttctgatcgggttgaatttcaggtacaacaaaagccacttgcaacgcgaggtcgcaagcggttagttatggttaaaattttggcaatattgaggggaataatgtcgtttaatttgccacctgttaccacatattacttgtattacaattattaccaccctatacttactccaacatcttaatgtaagaggataacactatggcattgaccgtaagactaccagacgaattacaacaacgcttagatcatctctccgtccaaacagggcgagcaaaatctttttatgtcaaagaggcattagaagcctatttggaagatttagaagatttactcttagctaatgcggttcttgaacgtgtccgttcaggtaaagaaaaaacctattcattagaggaagtcgagaatgagcttaacttggaacatcatcttagcggaaaccgctaaaaagcaattagccaaactcgctaagaaaaatcctcaacaggctcaacaaattatccgctatcttaaaaccttagctacgctagaaaatccacgagatcggggcaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgagttctcaggctcggttgtagattttgctacaacgtgggcaggataaatctcacttagcattttgtaaagtgaaatgttttcattaagattgatttttgaatgaaaaatagtaatatctctattgatgtttacaatatggtttttcataagtatgttaccccattgccccttagtgtttaggctaaggggttttgttttatgccaccattgtcaaatgattgcgtaagaaatacaaggcagattgttctagctttgccttgttcgtcgatatatttagcctccttaaaattaaggtggcgaaagttcattaaatctcaggttttctcaggttctagtgtttttctcatttttgagtaaagccctaggctgtactttcatttggtgctaccaactcaataaccgtagggcgaagtgagccgtcagagcttgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcagttgccacgttgcctgcgacaataggtaagttcgggtatttcgcacgggtttcacgcacacgttgtaacacaccctcagagtgaccgtgggaagagtcgataagcaagacatcaacaccagcctgaacaagagcatcaatacgttcttcattacctggaccagcaccgactgccgcaccgacacgcagacgacctaactcatctttacaggcgttcggtttttgctcagctttttgataatctttaacggtaatcatcccttttagtttgaagttatcatccaccattaacactttttcaactcggtgatcgtgcataagttctaaaatttcttcacgattagccccttctttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggcttatacggtgcatcagaaggctatgtgccttatatggcaagacaagaagctgagaaagaaaaacgagcggaagcagagaaaaaatttagagcgcaacatagtagtaagccgtcagtatttacttatgggaatgctgcaatgggaggtgttaagccacagcataattatcacggtgcttatgtggttgcagagcgtttaaatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttaagcagtatcagggcaaacttgataagccataccaagagctaaatgggttgcataatcgtatttttgagtcaaataacaacgccactacctcagtgacggtagtgagggaggaaaaagatgaaaattaaagtaaaagcaattaatggggtacgagtgccatttgagaaccacccccatagctatatcgaacacgagccggtggaagttgataactcaatatactatcagcgtcgtatcgctgatggtgatttaatcttagtcactggtgtagataaacctaaaaaagagagtaaataggaggggggaattattatggttgattttgacaaaatcccgaacagtattcgtaaaccaggagtatataccgaatacaacaataaagatgcagtgactaccctacctacgaatgagcaagaagtgttgatcgtggctccgatgacggctcaagtaatagggagttatagtttacctgtcaaagtatttagtgataccgatgctgaacaggcatttggggctggctctgtggctcatttaatggtgcgtcaggctattaagaataattcactgattcgcttaacggttattggattaaaagaccattctgcaggtgttgctgcgacagggcgtgtgacttttacagggtctgcaagcattgctggtgtggtgcgtgttgttatcggtggggaggcttatgaaattgcggtggcaaaaaatgaagcgaatactgccattgtcactcgtttggtggctgtgattaatgcctctcgttatagtcaagttgttgcaagtgcagaaagtgatggcgtattgctattgactgccaaatgtaaaggtgaaattggcaacgaattgatgttatcggctaaacacaccgctgggactttaagtcttgctgtcactgcatttggtggcggtcagcgtaatgcccagattgcaccagcgttagcaagtgttgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacgcccgactaatcctgcatcactcaaaaaggctaaggcatcttcaatcaccgaccattcggtttgatgattttgtcgttctagctgatgatatttttcacgaatggcttgtgaacgttcgataatgtgttggaaatccataatgttccttatttattttacagtttttgttccatcaaggtttttaacggttcaagccccaagcgttcatagaaactgaatgccccttgattgtcattccaaacgtgaagtgtcacactgtcgcaagcgtttgctttggcaaagtccaccatatactgatacaacttctcgccgattttcttgcctcgttgtgacgcatcaacacagagatcgtcaatgtacaacacattgcgatcaaataaggctggaatgccttgcataatttgataaatgcagaaagcatagccttgcacagtgtcgttttcatcttcatacacaaagatcggtttttgttcgtctgccattaaggctaaaatttcttcatcgctgtatttgcgcttacccgcttggaaaatatcagggcgagcttcaacgtgaacagcgtgaacttggtataacaactcggcaatacgagcgacatcatcggcttttgcaggtctaatcattgtttttcctaaatcgtgtttaactgtgtagcaagttgatttaataccatttcggtatcatcaagcaactgctcaaatttctccataccaaactgctggcttacttgcaattctgcttcggttagccgagcaataatcgggtcgataaaaattttaccgcttgcacttaaagcaatcaacttactgcgtttgtcgttctcatcaggcagaaaagccaaaaaacctttttggtctagttgtttacaaacagaggttaccgtttgtttcggcaaactccatttatcgccaatagcagtaggtgaagtcgcaccatagcgaccaatggaatacaaaaaatgcaattcatttaaggtgagctgatgttgtttcgctacactagcataaatgctcgacagctgtgctgctagctccaccaatttatcaaaggggggcatttttacgctccaaaaatttgacacgagtgatgtcataaagccagttaaacaccaaggtatacagcataatcagcaagctcaaaccaatatccgccaaaaaggcgtgccacaggcttaaatctaataaatatgcaactacgggaatggtaaacagcaataaggtacactcaaagcagacggtatgtaaaatgcgtaattttagactacgttcttcccgcttgccggtaaaaattttatcaaacacatagttaaagaagaaattaagtaccattgccatcacagacatggcaacccccgttccagccgcagcttcaaggctgaaatccccagccaataacactgcaaccgcaccgattgccattgctccaatttcaaataataccgagtgaaaaatacgttcgtaaaaagtcataaaataatcctatatcgtactaaataaatttattttagtacgatataggagtaaatacaactctatttgcaaatttctaagtagatctcaccgctttctaatctaacgctttaatcccttgaataatttggcaatggtcaatgtcttccgcctgacagtcaattaatggctcaagcaatactttaatttgattgagctgatcgatttgatgctcaatttggattaaatgctgtttcgttaatttatccaccagttcgcaacgattatgtggattagtttgcaacatgattagttgtttaatttcctctaagcgaaagccgatcatccgacaacttttaataaaatggagctgattgagctgtttttcactaaacaagcgatagccgtttggttgccttgttgcagtatcaattagccccagtttttcatagtaacgaatggtttccaaattcacgccactttctcggcttaattcacggattttaaaaaattttgccatggatgcttgaccctgtaattgctacggagtttatagtttacgccaagttaaacaaaaacacacggagagactatggcttgtacgacttcttgctgtacttcacacagcacaaacctttccccgaaatatcgcaaagcattatggattgctcttggactaaatattactctgtttttcattgaaatcgtgatgggcgtaaaatcgggttctgtttctttactttcggatagcttagatttttttggcgacagcgccaattatgtgattagcttgatcgtgttgcccatggcgttaagttatcgtgctaaagcctctttattaaaaggagcaaccatgggtggatttgggctatttattttaatcacaaccctctatcgttgggcttatggcgaactgccaaaccatagtgaaatgagcgtagtcggtgtgcttgccttattcgccaacctaacagccttgtgggtgctttatcattttcgtgatggcgatagcaatatgaagagtgtttggatctgctcccgcaatgatgcgatagggaatattgcggtcattttggcggggattgcggtctattttacccagtcgaaatatcccgatttgctcgttgctttcgttttggctttattagctctgcaaggtgcgagagagattattgttaaggcattaatggaattgaaaggataagaaaatagcggtgagattcaatgaaaaatttgcaaatttctaagtggatctcaccgcttgttatcattattccctatatctagggtacttctgtttatcttcttcagtaatcgctctcactactcggcatgggtttccaacggcaataactccagccggaatatctttagtaaccacgctaccagcgccaataattgtatcattaccgatagttacacctgggagaacgactacattggcaccgatccagacattatccccaaccgtaatcggtaaggcaatttccaagccttgattacgttgctcactatcaagtgcatgacccgccgtagaaaaaacacagttaggcgcaataaacacataattaccaaaggtgatcggtgcggcatctagtaaagtacagttataattgctgtaaaaatagcgaccaagccgtacattaacaccgtaatcgcaataaaatggtggcgtaattaccgtatcttcttttatctcgccaaataatgcttgcaaaattgcctgacgttttgcggtatcggatggtttgcaatgattaaattcaaaacagagatctgcagccttgaatctagcggtaatcaaagtgtcgtcataattcgcatcatataaatagcctgcttgtgctttttcccattctgtcatgttcgttcctttgtctaacctatatatctcaattataggctagttgtattgaatacaaagcagatttagataaaagctaattttattttttataaggcatctacataatcaactaacagtttaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgcgttgcgttgcgttgcgttgcgttgaacatttttgagatccttattttagtatgtcaagtaataattactgtttctctgaaatttctttaaaagaaatcgagaaagcatcttttaagttttctggcatcgtgcgatagttattaagtaagttttcttcttgttctgacattacaatttcttgtgttgcaatctgaaacatttccccttcaccactcacgagccagttcaaattcactccagctttggcgataccagtcataccttccgcatttggctcacgttcaccaccaacataaccttgtagggtgcggtaagcaattcctgtttgctctgcaaagtctttaattttccaattcttagcttcacaaacttgtcttaatctttctgatatacacatttgagcgtcctattttcaatattagattgacaaataacgcaaacgagcgtatatttgacattgtatagggtatattttatcacgtttgagcatagattaaatatcctataaacaaatttttaggtaatttcaagacttttatataacaaaaagaaacgactcaactatggcatctcacttcctattaaccagcaaagctcgcacgctttcatctattaagatagcacgcctatctgatgatgaagcatttagcttattgtgcgagctacgttggggaagtaaagaagtggtggtttgccctaaatgcggtgtgcaacataaagcctactttatctctactcgcaaacaatggcgttgcaagcattgcaaacacacatttagcattacatcagggacaatttttgcaaaccataaactgccgattcaaacctatttattcgctattgcgttatttgtgaatgcggtaaaagggatttcagcctgtcagctttctcgtgatttgaatgtacagtacaaaaccgcttttaccttatcacataaaatccgtgaaagcctgattgtacaacgtgagctttttccgctgtcaggtgaaatccatattgacggcacttacgtgcattctgctccacgcccaaagaataagaaaagtgaacgagtggatagacgtttaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagatcgcttgcatttcatcatagcttaaacctaaaccatcttttaagaactggtaggcctcgcagattaactgcatatcgccgtattcgataccgttgtgtaccattttcacgaaatgaccggcaccttctttacccacccaatcacagcaaggctcacctttgtcggttttcgctgaaatcgcttggaaaattggtttcacatattgccacgcctcgctattaccgcccggcataatcgaaggtccgtgacgtgcgccttcttcaccgcccgacacgcccgaaccgataaagcgaatgcctttttccgctaaggctttcacacggcggtttgtgtctgggtagtttgagttaccgccatcaatgatgatgtcgcctgcttctaagtgcggtaataatgcctcgataaattgatcgacaatctcacctgcacgcaccattaacatcactttgcgtggtttttctaatttagcggctaaatcttctaaggaatacgccccgataatatttgtacctttcgccgcaccttccaaaaactcgtccacttttgaggtggtacggttatacgccacgactttaaagccattgtcgttcatatttaaaataaggttctgacccattaccgctaaaccgataacgccgatatcgccttttactgacattttttgctcctgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaccaacgccaacaccgccggcattccttgtttaatcaaaatccccttattcttcgcacttatcgccccataaaccgcagcgataatcacacaacttaaaaagaaataagtgaccgcactttgttgaatacaaagggaaaaaataatcccagcagctaaaaatccgttatacaacccttgattagcaaacaacaacagaatttttggatcggttgccgtttgtttgtctaaattaaaaattttctcgccttcgggctgtttaaggcaaacatttctaaatacataatgtagaaatgctcaagggcgacaagggtggttaaaatatacgccagtattgacattgttttctctctatcttacaagtggtgcgttttgcaaaattttttgcagttctgaccgcttgcttattgttcttctaactgttctaaaattttactggttgataagtccattttagaaaaggcaaaccattttttgcctaaatcctttaatgaggcaccgatatggtagagttcggagcgatctaaaattaaaaatctatcgtgtgattgactaaacggttttatcgttattggttcatattgactattatagcgttctaaatcaagtgataactgtctgctgattgtttttgtataaagtgtgacattaacacctaatttacgtttactaaataatgttaaaacagaatcatcaagataattatcaatcaaaataatagaaaattctgcttttcttactaaatctgctacaaaagtataggcatcaaaggtttcgccatcaaaaaagataccttgagagcgaggtttatttccttctagagctaagaatacctgctccaattgcccagacatttcaatctgtttgcgttctacattttctagtcgctgaataacacccgcgttatttagcaatgtatgccgcatttgcacaaaagcctgcataattttaatgctgacttgaattgcaacttcactacgcaatacggttgaaagcattgcaataccttgttcggtaaatacatagggtaaatattttctatgtttaccctttgcatttttattttcttctttctctaagatcacaaattgtgatcttagagattgccactcactttccgtcaattgaaaacgaaattcctctggaaagcgctccaaatttcgtttaactgcttggttaaatgttctcgtttctacttgataaaggcttgccaaatggctatcaatcattacttggacatttcttaccgtaaaaatttgtgtttccaatttaggattaatttgtactaattggttcatcttttttccttcagcattttgaggtcacaactcgtgatttcaaatagaaattaggatgagccattttccaaccaagttctaatacttttttatgttttttcgacacagatcgcaaatttaaattttaaggtcacaatttgtgaccttagagactctgaaaaatctatctagcttgccaatatttctgccattattgctcactatgattttgctcaaaaatcatcttctgattttcaatttctcgtaccaactcttcttcgcttggcaaatacgccatatatttgctggcaaaaagctgcgagctgtcgttcaataccgaatatttcgccactacgctatcggtttcggtgcaaagtaacaagccgatagtgggattatcatcagggcgtttttgcaaatcatcgtacattcgcacatacatatccagctgcccaatatcttgatgagtgagcttttctgttttcaactcaacgattacaaagcattttaaaatgtaattgtaaaagactaaatcaataaagaaatcggacgtttcggtgcgaatacactgttggcgagccacaaaagcaaagcctttgcccagttccaacataaattgttgcagattatcaatcaacgctttttctagctctgcttcggtgtatgccaagttagtcggtaaattcaaaaattccaatacggtgggcgatttaatcaaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaaagggcgttattcttagaatttatacaccaagttatcttcatattttcctctacaatttgtagatgtattcaccacaatccgctttgctccatcgaatgcttgccaattatccactttatcttcctgcatatactcaataaaccgaataaactccgattttgttgaactgaagaaaatatacggcggcttggttaagttgatgagccttagaaagtcaattaaatcaaaataggttgcctgtttgtagctttcttgcttggtgcaaagatagggtgggtcaagcacaagtaacaccttttctttacctgaaaaacgcgacactaattgatgaaacgactcgcaaacaatctctacaccatcaagataactctctgcacttggataatcactctgccgtaagcaatgccagaagtcttgagtatataactcctcaagactcttcacttgctgaccgctaaacaatagccaagaacatagaatatgtggatctttatatcccttaaacgcttcaataatctcaattagttgcaattttttcgtcttatctaaccgcttacctttggggcaatcagcaagggcaacagctaattgttggcgtagttgattaatgtcgggtatatgttgtaaacgctcggcataattatcaaaatcgttgtaaattaccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttggtttcttatgcaggttctgactttgatgttcgttcagtcaatgctaggggtaagcgttatcaagcaacggatacctttgttgtgttggtaatggctcgctctatgcgttccgccgttgcggggcgtgtgggtggcgtaacatctcaagaagtcggcgtaaatctgttgcttggtgcggtgaagtatttgctgattaatcaaactttaggggggttggtgtcacctatccaacccaagcgaatccgcactatttggaataatgcggaagtgaaaaaagagaaaatctctgcttttgcgattgagtttgaaatgagctacaccgaaaacggctttttagaggatgggcgattcccagagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggaagattttgtgattaagccgtttgagcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgttttaaccataaggggatacaaatgaaaaagaaaccagatgcactccagcgtgagcggtttaagtattttagtgagcttgcttcgacacttgagcgtgaaggcaagtatttacaggcaggcgatgcgtgggataaggcgttaaactttgcgacgaatccacttaatcaaaagtggtgcgaaagccgttgtgaatactgtaataaaagagcttaaggggtaannnnnnnnnnnnnnnnnnnnnnncaaataaaagaccgcttgtatgacttgattgaaaagctacaaggggcgacggaattagtcgaaatggacgattttgcactggctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttccttatagttggttaaaaaattctacgctactttacgattcgtaagtgccgccgtcgccgccaaagcacttgcggcttcttcgatggcctctttaccctgctcgttgctttctcggtagtcttcaagtagggtttgttctttttgggtgagcgtgctttcaggtgtgctttgcaccccagaaaagaccctatcccaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaattccgcaccttaaacagttcaaaaggcccagcagttcgagcaacccgcgcgcaagcagatcgtgtactttaccgccaagcggtgcgtactgcattagaaaatcaaccgaatttggatattttccaacaagaagtcgtggatattttggttgaaaataaccgtgcggttggtgcagtaactaaaatgggcttagcctttaaagcgaaagcggtcattttaacggcaggtactttcttggcgggtaagatccatatcggtttagataactacgcaggcgggcgagcgggagatccagcagcaaccatgttggctgatcgtttgcgcgatctcaatttgcgtgtagatcgtttaaaaacaggcacaccaccacgtttagatgctcgcacgatcaattttgatgtattggcaaaacagcacggggacgaggttttacctgtaatgtcatttatgggatccgttgagcaacaccctcgccaaattccgtgttacatcacacacactaacgaacaaactcacgatttgatccgtaatagtttagatcgtagcccgatgtacacggggattattgaagggatcgggcctcgttattgcccgtcaattgaagataaagtaatgcgttttagcgatcgcaacagccatcagatctacctcgaaccagaaggtttaaccaccattgaggtttacccgaacgggatttcaaccagtttgccgtttgatgtgcaaatggggatcgtcaattcaatgaaaggcttggaaaacacccgtattatcaaaccaggttatgccattgagtacgactatttcgacccacgagatctaaaaccaacccttgaaaccaaagcgattgacggcttattctttgccggacaaattaacggcacaaccggctatgaagaagcggcggcgcaaggtttattggctggaattaacgctggtttacaagtacaaggcaaagatgcgtggttcccgacccgtgatttagcttacacgggtgtattggtggacgatctctgcaccttaggcaccaaagagccgtatcgagtattcacttcccgtgcggaataccgcttgttgttgcgtgaagacaatgccgatgcccgtttaacaccgattgcccatcagtttggtttaattgatgaagcacgttgggctcgttttaacgagaagatggaaaacatcgaaaaagagaaagcgcgcttgaaacagacgtggacgcacttacaaatggcgaaccttgcggaagtgaatgcattattaaatagcccacttgcccgtgaagcaagcggtgaagatttaattcgccgtcctgaagtgacttacgaagccttaactcaaattgccccttttgcgccggcgattgaagattaaatatcaaggctatatcgaacatcaacaacaagagatcgaacgccataaacgccacgaaaacacgcaaattccagctgaatttgattacgacaaagtggaaagcctgtctaacgaagtccgtgcgaagctaatgcaacaccgcccagtctctatcggacaagccagccgtatttcaggcataacccctgcagcaatttcaattttgttggtgaatttgaaaaagcaaggaatgttgaaaagaggtgagttgtaaaattgataaaaccgtggcgatttgttacggtttttttacacaattaagggatactgtaatgaatatttttgaacaaattaaacaaactgaaaataacagagaattttggtctgcgagagaattgcaaccattactcggttatagcaaatgggagaattttcagcaaacaattagccgagctatgcaatcttgtgagacagctggatatagtgtattggaacattttcctgaggtcaggaagatgttcattattggtaatggggcacaacgtgagcaacaagattatcaacttagtcgctatgcttgttatttaattgttcaaaatggcgatcctaaaaaagaggcaattgcagtaggacaaacttattttgctatacaaacacgtcgccaagaattgaccgatgaggcttttacacaattaagcgaagatcgccaaagattattacttcgtcagcaattacgagaacataattccgagttggctgaagcagcacaaaaatcaggcgtagaaacccctgttgattatgctatatttcaaaatcacggctacaaagggctttatggtggaatggattataatgctattcatcaaaataaaggtttgaaacaaagccagaaaattcttgatcatatgggaagtacagaattagcggctaatttattccgagcaacacaaacggcagataagttaaaaagagagaatattcaaggtaaacagcaagcaaatcaaactcattatgatgttgggaaaaaagtacgccaaactattgctgaacttggtggtacaatgcctgaaaatttgccaacaccagaaaaaagcattaaaaagctagagagtgagcagaaaaaacgtgagaaattagcgttaaaaaccggtaataaaaaataagtgataacaggaaattgaatgaaagacaaagcattgccggaagggtggaataaaataaatataactaaagtatttacccaaatatcaacaacaggtaaaaatatctcaaccaaagattgtttatctgttggtaaataccctgttattgatcaaggtgctgaatatatttcaggctattttaacgatgaaactaaagttattcctgttgaaaataaggtaattgtttttggtgatcatacaagaaatttcaaattaattgattttgattttattgttggtgctgatggtgtaaaaatttttcaacctgcaaaagatatagatcctgattttttttattatcagtgtttgtcattaaatttgcctaataaaggttatcatcgccattttcgttatttgaaagagtgtgattttatttacccttctttttcccaacaacaaaaactcgccaaaaaattcaccgtacttttatctcaagtggcagaaatcaaacaacggcttgagaaaatccctgctttactgaaaacttaccgccaatctgtgctggcaagagctgttaatggagaattatcggcgaaatggcgggaagaaaatggggtaagtttggagagttgggtatatgaaaaagcacaacatatttgtgataaagttcaaagcggttcaacccccaaaggtaatccatttgagcaaaatggcacaattccttttttgaaagtttataatatagtaaatcaagaattaaattttgattacaaacctcaatttgtaactaaagaacaacactcacagcgttcaataacattacctaatgatgttttgatgaatattgttggtccgccacttggaaaggttgcgattgttacaaatcaatattctgaatggaatattaaccaagctattacgctttttagatgtaatcctagaaatttacattataaatttttttactttgtccttcgagaaggtagatttattagagaaatagaacacgatttaaaaggaattgttgggcaaattaatatatctttaagtcaatgtagagatatgattgttcctgtaccaactcttgaagaacaaaactacatcacccaagcggtcgaaaaacacctaaactttgccaatcagcttgaagcccaagtcaatgcagctttggaacgggtaaatttaatgacacaagctattttggcgaaagggtttcgtggggagttgatataattgccaaaattttgccaataattttaaataaaaaccgaggagcgaataatggaaaccaacttctcttttcttcaagcctttccaaccttattcaaacaggttcaatttgcggaacgttatttttctgaagatccgaatacgtcaatgtataaactccgccaatttggcgagtttttagctaagcaaattgccgtacgttttcgtttggctctgcctgaaaatatcacgcaaaatgatcgtttaaaagcattgaaagaatgtcgtcttgatcgtgagattttatcaatgtttcattttctcaaaaatgcaggcaatgaagcggttcacgaagggattgaagatagccaaaaagcaattacagcaatgattgcggcttggcagctttctatttggtttgttcgtacctttggcgataatatggcaaattttgagcctgtaccgttttgtccggattatttacaagcggtaagaaacaatgaaaatcttgcaaaatacactgaaaatccgaccgcttcgcaacaggaagaacagcaattagtcgaagctaatcaagcagaaattcaagccatttccaccgcactttcaaaccaaagcgaagaagaaaaacaagcctttgatgtggcacgcgaaaaacgtgcagcacaagcctttgagcgtttgaagaattatgaattacgtttgttggatgaaaaacaaactcgccttttaatgattgaccctatgttgcgagaagccggctgggaagccgatagtgaaaatttggattatcgaaaaggtgttcgccctgaaaaaggacgttatcttgccattgctgaatatccggtggggaaagatcgtgcagattatgtgcttttttgtgggttagtgcctgtagccattgtggaagcaaaaaaggcgaatgtgaatgttgccagtaaagttgcacaagcagagcgttatgcgaaacagtttgagatcacagaaaatttaaccgcaccttgggtgttggcgaaacggacggtcgcttgggcttcagatgaaagtgccaatgatggcttgcatttttatgtaccctttgtgtattcctgtaatggtaaaccttatcttaagcaacagctagaactgtcggggacgtggtttagagatgttcgtcagccgtctaatcttaagcgtgcgttacaacaatttcatacaccagatgtattactggaaatgttaaaaaaagatgaagaacaagcaacgcaaaaactcgaaaatgaaccatttgatttcttggggctacgaccttatcaagagaaagctatccaagcggtagagcagaacttgagtgaaggtaaacgagaaatgttgctggcaatggcaacgggaacaggaaaaacacggacaattacgggattaattcaccgctttttaaaaacggatcgttttcgccgaattctttttttggtggatagaaccgcactggcagagcaagcggaagatacctttggtgggatgaacgtggaacccaaccaaactttaaatacgttgtataactttgcggtgaatggtgtggttgaacctgaaacgaaagtgaaggtggcgacggtacaatctttggtaaaacagattttttattcgggcgaagcaccggcaattgatcaatttgactgtattattgtggacgaagcccatcgtggctatacgcttgatcaagaaatgacagatggtgagttagaatttcaagataatgagcaatatttatccacgtatcgccgagtgttagattattttgatgcagtaaaaattggtttgacggcaaccccagctctacacaccaaagaaatttttggtgagcctgtttttgtctattcttacaaagaagcggtgattgatgattatttggtcgatcacgagcctccgatagagattaagacgaaacttaatcaagatggtattcattttgagcgtggcgagcagttagaatttatcgacaccagtacaggtgaagtggtgttaagtgaacttgccgatgagcaaaattttgatgtagagagttttaatcgcacggtattaaatgacagctttaatcaagtggtttgtgaagttttactggattatcttgatccttttggcagcgaaaaaaccttgattttctgtgcgacagatctacacgctgataagattaaaggcatattagataccttattcaaacaaaaatatggtgatgagtataataccaattccgtggcgaaaattacggggcaagcggataaacctaatacgcttatcaaatattttaaaaacgaacgttacccgaatatcgctattacggtggatttgctttctacggggattgatgtaccagagatttgcaatttagtctttttacgccgtgtaaaatctcgtgtgctttatgaacagatgaaaggtcgagcgacacgtaaatgtgaagcattaggtaaaagcgtgttccatatttacgatgcagtgggtttatgccgagcaatggcaagtgtggataccatgaaaccgatagtgaagaacgttcatcaacccatttcgcaattagtggaggaattacaagcggtaggaaaaattgaaaataatacaaacccactagccaatgaacatcagcaggcattacttgaacaaattagccaaaaaattatgcgattgctgcgtaaagcagacaaaatggcagaaaaaagcccacagatgaaggaaaatctcgctattcttgaacaggaatggggcgtaaaacctaatttgttgcataaacatttacttaagattggcgttcaaggggcggtacaattttttgaaaaacatcgcaatatcttaaccgaatttaaccgcttgcaagctatgttaccaagcgaacgaatgccagtgatttctacgcacgaagatgaagtgcgagaaattaccccaatctacggaaagggcgaaagtgcggacgattatttgcaagaatttatggcctatattcaacagcatagtaacgacagtgttgcgatacaggtaattattaaccgccctcgcaatcttactcgtcagcagcttaaagagattgagcttgctttagatgcacaggggtttagtaaagcgaaactgaataaagcaatggggcaaaaaacgaaccgtcacatttccgccggtattgtggcgcatatccgccgtgcggcgattggcgacagtcttgttccttttgaacagcgtgttgatcatgcgattgaaaaattgtgccaaacacattcatttaaacccaaccaacaaaaatggttagaacggatcgcaaaacagcttaaacaaaatcacgatgaaattttagatcgtagtcgtttaaccgagctattccaagggcaatttagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgttatcgatcagctaaaaaccttagatgctcgtattcaaacccttgatggacaagaagaccgctttgtcaccgtcgagaaaaaagacttgctggtggactcttatgtgaaatggaaaatcagcgattttggtcaattctatacttcaactggtggcgatacacaaaaagcttcaaccttattacaacgtaaagtcaatgaccgtttacgttcagaaatcggttctcgtacaatcaaggacatcgtttcaggctctcgtggcgagctgatggctggcgctcaaaaagccttaaatgacggcgaagatggtgcagaacgtttagggattgaagtggttgatgtgcgtgtaaaacagatcaacttaccaaatgaagtatctgcgtcaatttatcaacgtatgcaagctgaacgtgctgccgttgctcgtgaacaccgttcacaaggtgaagaaaaagcagaatttattcgtgctgatgttgataaaaaagtggtgctgattttagccaatgcaaataaacaagaacctgagttttacagttttgtgcgtagtttgaaggcttacgaagaaagttttgccgcaggctcaaacaatatgatgttgcttaaaccagacagcgaatttttccgctttatgaaagcacctacaaaatagttatatccaaagacccgataaagcgggtcttttttatctttaaaatagaaagctacaacgaggttgtaaaattttaggttgttatataacagtttatattaaccaaaatgtagggacacactgagtgtgtccgctcataaaagatcatattgaggacacactcagtgtgtccctacagtatgcctgaaagattgaggtttagcgtaactgtaacaaccaaaaaaatctaatcgcttgtatgcttttgacattcactaaacctaactaaaagaggcaatttattatgggtaaaagtgttgcaatccttggggctcaatggggcgatgaaggtaaaggcaaaatcgtagatttattaacggatcgtgtgaaatatgtggttcgttaccaaggtggacacaatgcaggtcacaccttaattatcaacggcgaaaaaaccgtacttcgccttattccatcaggtattttgcgtgaaaacgtgacctgcttaatcggcaacggcgtagttctttccccatcagcattaatgcaagaaatgggcgaattagagtcccgtggtattaacgtgcgtgaccgcttaaaaatctctgaggcttgcccactaattttgccatatcacgttgcaatggatcacgctcgtgaagcggcgttaggtaaaaacaaaatcggcacaacgggccgtggtatcggccctgcttacgaagacaaagtcgctcgtcgtggtctgcgtgtcagcgatctattcaaccgtgaagcctttgcagaaaaattaaaaactattttggaatactacaacttccaactggttcactactacaaagttgagccagtcgattaccaaaaaaccttagatgatgtttttgcggtagcagacatcatcacaggtatggttgcagatattacaaccctattacacaaagcacgagccaatggcgacaatatcctgtttgaaggtgcgcaaggcacaatgttagacattgaccacggtacttatccatttgtaaccagttcaaatacgactgctggtggtgttgcaacgggttctggcttcggacctcgcaatttagattatgtattaggcatcatcaaagcctactgtactcgtgtgggttcaggtccgttcactactgaactttttgatgaagtcggtgcagaaattgctcgtaaaggtaacgaatttggtgcagtcacaggtcgcccacgtcgttgcggttggttcgatgccgttgccgttcgccgtgcaattcaaattaactcaatctcaggcttctgtatgaccaaattagacgtacttgatggctttgaggaattaaaaatctgtgtcgcatacaaattaccaaatggcgaaatcgtagaatactcaccgcttgcggcggcagactgggaaggggttgaaccgatttatgaaaccttaccaggttggaaagataatactttccgtgtaactaaattagaagatttaccgcaaaatgcgatcaactacatcaaacgcattgaagaagtgttaggtgtaccagtcgatattctttcaacaggcccagaccgtgttgaaacaatgattttgcgtgatccgtttgtagagtaattagattttaacgataacaatcccctggtttgtagaaattaggcgattttttgtataaaacagatcggatctgaccgctcgtttacatttatattgcgaacttagtggcaaagtagtgtaaaatagccaagttttcgtgatttatattcatagaggaaaaagaatgaaaagagtagtcatcacaggtatcggcattatttcgagtatcggtaataacaaagaagaagtattagcttcattaaaagaaggtaaatcaggcattgaatttgtacctaaatttgctgaagtgggtatgcgtagccaaattgcagggacgattaaattaaacccagcagaattaattgaccgtaaagtataccgttttatgggcgatgctgcagcttatgcttacctttcaatgaaagaagcgattgaagattcaggtttaaccgaagagcaagtgtctaacgaccgtaccggtttagttatcggtgcaggcacaggctctgcacatagtcaattagtggcttgtgatgcagtgcgtggtcctcgtggcgtaaaagcagttggtccttatgccgtaactaagacaatggcttcaagtgtatctgcttgcttagcaaccccttataaaattcgtggtgtaaactactctatcagctctgcttgtgcaacctctgcacactgtatcggtcacgcaatggagttaatccaattaggcaaacaagatgtggttttcgcgggtggtgctgaagagctatcttgggaatgtgcaacggaatttgatgcaatgggtgcagtttcaactaaatacaacgaaaccccaactaaagcttctcgtgcttacgatgccaaccgtgacggcttcgtcatcgcaggtggtggtgctgttgttgtggttgaagagcttgaacacgcccttgctcgtggtgcaaaaatttatgcggaaatcgtaggctatggtgtaacatcagacggttacgatatggttgccccaagtggtgaaggtgcggaacgttgtatgaaacaagcgatggcaacagttaaaggcgaaatcgaatacatcaacgtacacggtacatcaacaccagtgggtgatgtgaaagaattaggcgcaatcaaaaatgtctttggcgataaaaccccagcgatttcatcaactaaatcaatgactggtcactcattaggtgcagcaggtgctcacgaagcgatctactcgctattaatgttagataacgatttcattgcaccaagtatcaacattgaagaacttgatgaacaagcacaaggtgtgaatgtcgtgacagaacgccaagacaaagcattaacaaccgtaatgtctaacagcttcggctttggcggtacaaacgcttgcttagttttccaaaaatatcgaggctaatcttgcttaatttttgaaatctgatataagggagtgggaattttcccacgtcttttttatttatttggagtgaataatgttaaagtttaaacatttattatctattttagtattggcagtttcggcaaatgtagtggcaagtggtgtatcaatggaaatgttccaaatgaaacgccaaattaacctattaacaaatgcccaaacagctgaagaatttacgcaaaatgcagataaatttatcgaagtgtctaaaaaagcccaagcaactatgccaaacagcttagatggcgatcaagaaaaattcaaaggctatcaacaaggtatgcaagaagtcatcgatgtggttgctcaagcaaaaaacttagcaagtcaaggtaatttaacggaagcaaaaacagttattgcacgtttagatagtttaagaaaactgtatcattcggtatataaataaacatctagcctaaagttaaatggacgaaaatggtgtaatagacaaatttgttgcaaaaaagcagcttaaaaaagtctctcccacaatttgtgggagagactcatttattgagaacattaagctatctttctcaataatatcaactagttgcttattcattctctgataggaaataagattacttttatcacgattaaatagtgaattaagtactcgttgagagttaattatttcctcatataaaaaagaattttctaaccgttcaacataatcagcataacttaaaataagttacatttttaccttcttaaattaaacaattttctatttctgatgcattttgttctagctctcttaatacctcgatgaagaattcaagagttttgatcattctaattaattcatccttagaacgttgaattttttccctatacgctggatatccctttgcttttaaggggactatatagttcagcatcatccctcggttttctgctttatcaatttcatctttatatatattaataaaaccatccattttattaatgagtttattaatatcctcaataagtttttctagaatttttatttgacccaaatagttttgtgattcatttgccatagattttcccctctttgactagtttaaagctttctgacattatcagccaatccaccttgtatatgattatttaattgggcttttccccctaatttctctattgcattattggctaatattgcttgagtttgaaagccacttttgtgatttcctaataagaagatagcatctctagttaattcatcaaaatatttccaatgatgctccattgtttgtcgaaaatcattaagcgtattgctgaaaattgcactattaatagcaacccttagatcatcaattgcctttttatttaatttatgccaagtatctattccctcacaaaaattgttacaacaatcaatctggttttgtagagattgcaaattattaaaactcattattttttctccattatttagaatgtcatttactttatttttttacgttattacgtaatttcttaattgggtctaatcctccacctttattaccactattgttgatatcaaagcttggattttctaatgggcgagatgatgatttctcaatacgagattcatctaaaaaatctcctctcccttgattatctaaatttatcaaaatatttatcccaatctgtatcaactggaggaatgttttctgcagattctgattcttttaaaaagatatcattttgctctttattaatttcactattagagaaataagtgacatcattcttatcgtctagaaccgatattgaagaacttattgaattctctgatagactgctatgcattgaaatatcatctctcgttatcgtattaatcacaatacattcgtaatctcttcctctatattgttcaataacctcttgaataattaaatcatctgcaggtttattcattaaaatacgttgattattttccttgactcccattccatcgtttaaaataaactgaaatggttttagataaacaggtgcttcattacctatcataaagattttcattgaatctgatgtattaacagtaaaagcaatacgcattttaaattgtgttaataattcagaacttattgtatagcctgttagtgtctgagtagacataatcatatgcaatccaaaggctcttccccgtttagccaaatcaatcaataatttctctattttcgaagatttaggatgctcaaataaacattgcacttcatcaataattaaataacttcgacttaactgtgagtctgtagataatttattatattgatctatatttttaacattttttgcttaaataatattcctctttcttttatcaaattagagaatttctgcaatgcatcaataactgggtcaacttgggaattatctaacattaatactcggatatgcggtaatcctaggtacttctgaaattctacaccttctttataatcaaataggtaaagttccgcttgctctggtgtaaactgagaaacaattcctttaataatatgatctagcagtgttgtttttcccgtgccattcataccgaccataaatgcgtgataggcttgatttcttactcctaattcaaagtaacatttctctttaccatttggtgttaccccaacctcaatttctaagaatgcttttggtttagatgcttgactaattctatactcttcttttaaattgtttacaacttgattaaagatgtgcttaaccccatctcgttgagataattcaatagtaagtttattatttttgatcagtgtgcttaatttattaaatagatgggaattttcttgaagaaatatatcttttccgattaattctaaacttggtatctgactaagtaatttagtcattctatcacctagtgcctttctttttttatcatcatcaccatttttgagataatggttaaattcttcattgtcaaaataaaaaataaacttaactcctgctgaatatgctgaagcaataatagtgtttagaaaatctaatctatcatttgataccgcataatcattcaaattaataatatttaatatgtaattttcttgtgcccttggatcaacttgttcattatattgataaattgaagtaatattatcatcaattaaattataagatcgctcacgaactaacgaagctaaccattgattaaatttattaatggcatcatcactaaatattgaaatatttttttgctcattaagtcgcataatatttggaaatatgttatataacgacttatcaataatattaattttaggtacttgataacgtattaagcctaaaagaaaatgagcggaaatatcttcacaaagatgggccacattctgcttatccttctctgtatagtgaataagcaaactatgactatcgctaggaatcaccgcaggatagagttgccctctggtcgggtggcgtaattcaccaatgtaaattccccaaggataatgggttccttgaattgcaatatctgtttgaataagctgttcttgcattgctaacctcggtctataactcatttatgctaatttacaattattttgtataaatctgatactatataaccaaattgtacaaaaaaacaactgtgcaatctttaagagaatatattagataattaaatctaagtgttctctaaccaattgtttttaatgaaaattaaacattttaatgtttaaaattaagagattttacaaatgatgtgtataatgcggagaccttataatgtaaaagcccttatcttagttataaaccgtaataacagccttaaataattgcaaaattcaaatctttgtacaactgttacagcatcctattacttgctcaaccccaaaaggaaaataaaatgacaacaatcacattacaacttgacggcttacattgcggcaactgcgtgaaaagtgtagataaagcattacgagaattaccaacagtaagcgacgtgaaaattgatttagcaacccaaattgctgttatcgacggtgaagaacaagcaaaaaccttgattgatgccattgttgatattggctttgaagcaaaagaggcataatctaatggctcaagagcaacaatttttgctcaatggcttacattgtgcatcttgtgttcgccgtgtggaaacggttatcggacgattgacaaacgtggaatatgtgtcagtcaatttagctgatcaaactgcctttgtacaaggtaaggtcacggctgatgcggtagtacaagcggtgacaaaaatcggtttcggtgcagaattgctagaaagcgaagaaattcgtcgggcaaagcagcaagcccaaactgcagcagccttaacccagaagcgtcgtcaatttactgttgcattagcggttggggtaatgttaatggcatacggaatgtggttcggtacgtcgccaactgtagaaaatcgtccgctttggtttgcttgggcggtcatcaccgccagcactatgttttttagcggcaaacacttttttacaggggcgtggacaagtctaaaacatcgtgcagccacgatggacaccttaattgcaattagcacaggcgttgcctttctttattcgctgtatttaacgctatttcctcaatcccattcccatttgtactatgaagccagtgtgatgatcatcggctttctcaatctaggaaaatatcttgagttaaaagtaaaacagcgttcatcgcttgccttagaaaaattgctggatttagcaccgcagcaagcggttgtttttgacggagaaattacaaaaaccatttcaactaaaggtatcaaaccacagatgcggattcaggctctgacaggagacagatttgccgtggacggcgtgttgcagagcggttcattatgggtagatgaatcaatgctcacaggcgaagcgttacctgttgagaaacgagtaggcgataaagtgcgagctggaaccattgttcaagatggtgctggtatttatcttgccgagcaagtgggttcgcaaactgcactagctcggattatttccgcagtccgtcatgcacaatcctctaaaccaccattagcacaatgggtcgataaggttgcgacggtgtttgtgcctattgtggtgagtattgccttgttcagtgcattagtttggttggcattaggtcaggattttgcctttgcattatctattttcacaacagttttaatcatcgcttgcccttgtgccttaggattggctattccactttccaccattgcaggcgtcgctcgttcggctgaattgggtgtattagtaagaaatattgaagcactacaagcgagtagtgaaattgatactttggtgtttgacaaaacaggaacccttaccactggcgaaatgcaggttacacagattaacaccttaggcaatgtatctgctgacgaagtactacgtttagccaaaagccttgaacagcaaacggctcacccgattgctaaagcgattgtaaaatatcaccctgatctgaccgcttatcctgcgagtaacataaaagttgccaaaggtttagggatttcagctcaagtgggagaaaacaatgtaaaagtaggcaatcggcaatttgttgcttctgacttttgtgaagagcaagatttgactacgcaagttttcgtttcactcaatgaacagctcattggcgtgatctatttgcaagatcaacttcgccctaaaagccaagcggttattacacaatttaaacagcagggctatcgctgcataatgctcacaggcgaccgccaagctacagcaaactattatgccgaaacattgggtttagatgaagtgattgcagaagtgttgccggagcagaaagctgaacaaataacgaagttacagcagcaagggcggaaggtggcaatgatcggtgatgggatcaatgattctcccgcattagctcaagcgaatgtcggtgttgcaatgtacaatggtagtgaaattgcgatagaaactgcggatctctcattaatgcaatcgggattacaaccactagcagcaattttgcccttctcaaaacaggttgtacagaatatgaaacagagcctagtcggtgcctttatttacaatatcattgccattccgattgcttgcggtgtactttatccttttactggctggttattaaacccgatgattgcggcagttgctatggctttgtcgtctgtgactgttgtgttaaatagtcagaggttgttaagataaaagtacaaaatagagagcaaaaaagaattctatttaccttcgtgtcattaccagccccaaccattcaaggagtgatagaggatcactatttaggtgtctgcgttactgttagattcatctatttcagtatttttgagtaatgttattatgctgaagcataacaatcttattttattgcttacagctccgtgccgtaaaactccgctatttttgttcacatccaacgaaaaaagagaaatataaaagccttgaagtttttacatttcaaggctttatattatgtttgtctagatctgctgaaatcaatttggtggagataatcgggatcgaaccgacgacctcttgaatgccattcaagcgctctcccaactgagctatatccccaaaattgcgagagatgatatgctctcgctttttttctgtcaatctgaaaacaatggaaatagattaattgattaaaaactaactagttctgcgcttcaataaacgcaatcgctttttgaatacgcgcaagcgttctctctttgccaactaatttcgcagtaatatccatagatggcgactgccctgagcctgttactgcaaggcggaatggcatacccactttacccataccgatgtcaagctctgcggcagtttggttcattgcatcgtggatattttcaacactccaatcatcacaagcggtcagtttttccaataattttgcaagtggtgcaactgcttctgctttgaagttttttgcgaccgctttttcatcatagctatcaaattcttgatagaaataacggctttggcttgctaattcttttaaggtttttgcacgttcgcttaagactggaatgatctctgctaatgcaggtccttgagagaaatcaaccccctgatcattcatatgccattcaaggtattttgccacatagtctgcaggcaaactacgcatataatgttgatttaaccactgcaatttttcagtgttaaaggcacttgccgatttgcttacagaatgaatatcgaataattcgatcatctcttcacgagtgaagatctcttgatcgccgtgtccccagcctaaacgtacgagatagttaattaaggcttcgggtaaatagccatcatcacgatattgcattacgctaactgcaccgtgacgtttggaaagtttttgaccatcatcgccgttaatcatcgaaacgtgagcgtaagttggaatttctgcccctaacgcttttaagatgttgatttggcgtggtgtgttgttgatatgatcttcacctcgaacaacgtgggtaatgcccatatcccagtcatcgacaaccacacagaagttgtaggtcggtgcgccatcggtacggcggataattaagtcgtctaattcgctgttgctgatttcaatgcgtccacgcaccgcatcatcaaaaatcactgatccttccgttgggtttttaaaacgaacaacgtgtggttcgctcggatcgtgtgaatgatcgcctaagcagtggcggtcataacgtggtttctctttattcgcttcttggtttgcacgcaattcatctaaacgcccttttgagcagtagcaacggtatgccgtgccttcttcaatcatttgatcgatcacttggttataacggtcaaagcgtttggtttggaaatatggaccgtgttcccacgctaagttaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgttcctgttgcagggttaccatcaataaatttgcctgtattggattcaatatttggaagttttgttttcatttcttaatacctttaaatgtatgcgaaatagcaataggtgtgagcaggttttaaatctgtaaaaaattcttctaaaattcggtcgccaaaatccgttaatcgttctcctgccacagattgcccagcccgaaaacgagtaatattgttatcaccatttgttatagtaacccgccacatataccccaaatgttctctcggggaattttgaatcggaatatcgcctgcatcgggtaaatcgttttgcaaatgagaaaactctttaatttcaatggtatagccaatagacttcgctaactgtataaaataaggcatagaaagccccccaaccgcatttaatgtcagaatgactttattgactctactcgaatacgatttagaaagatcagtacttatcccacaaaccctttcccaatctgccaacatctcacgagatgtatctggggtaactgcattgagcattctttctgcactttgttgcaggaggtcaaaacatcgtccatcaacctcacattgagcaacaaactgctcaccattaatatcataggaaactggaggataaagcgtttttagaacatttgcgtgaaagctcattgcattaactccactgtaactcgccctaacctaaaccattcaacatttggcacagtattcgcttgtaaattagagcttggcgaaataattcgacgatcaacaaccccaatcaagtcactcacaatcgcttcacactgcgatacaatcaagctatctgcagggcttaattgattaaaataattacctaatgcggactcaatttctgctttaatggtgactaaatccacaccactcaatttcactttgatattaaagtccgttcgtctagctgttggtttaataacttttgactctctagccgtaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtcgcattactagctaccctttgctaagatatgacttgtctagggtctgttatcttagtgttatcttagcaaagaacgcacgaaacagattataggaaaagggcatagatgtcaaaatctatgctctttttctatgagaaacaatacaaatattttataattacctaatcttacttaccttttaggtatggggcttagtcgtatgggtaatgattcttttataagattttcttatgttttgttaatgggttttggttttcctattatgcgttatatgagtattcattttgatactttaaataataatgctgttcgatttctctctggtgggttgttattcgtttttatttgtatattaaaatatagaacagaactacttaagttgctcagagaaccttcaatcatcttatatcttcttttgttagctatttttatgactggtaatatgtatttttttattaatggtcttaaatatacttcagctttagcaggcagtatttttggcattatgtctatgcctttagctgttattatggccgcaattttctttcaagatgaaagggaaaaagtaaaacaaaagagcttttatattggtagcgtcttatctgtaattggttctttgatatttgtaatttatagcaacaaaactggtgggggtaatgattttataacagggtcactctttttggggacagctatatttattcaatctattcaaaaccttttcgttaaaaaggtcgcaaaaaaattaaatgccgtcgttatcagtgcatccactgctactttatctggacttgtttatctacttttagcaagtaatacaggtgttatttatcaattacaagatattagttcaggcttgctgatcggattaatctttgctggaatgtatggaatgccaacaggtatgttatttgcattttatattgttcaaaaacaaggggtagttgttttcaatattattcaattaacagttcccttatctactgcgtttattggttactttactttaggtgaaactatttctatttatcaaggttttggtgctgcaatcgttattgtaggatgtgttatttcattgaggaaaaaatcccatggagattaatatgtataatgtgggtgttataggattaggcttgattgcttatggtatagataaagatccaaacagaaaaatcatatggagtcatattaaagcatataaaagtattgaaaatatacgaatatcatcagtatgtgatgttaagaaatctttggtagattctatccaaaaagaatgtgatataccaaatggatatacagattataaagaaatgctgaaatctaataaatttgatattgtcagtatatgtacacctattcaaacacattttgatatcatcaaagagtgtattaagaatggagttaaagtgattttctgtgaaaagactgtttcttattctctagaagaatctaaggaaatagttgagttatgcgataagcataatgttattatcgctgttaattacatttttcgttgggataatcttattcaagaaatcaagggactattagattcaaatgctatagggaatatttattctttagttggttatggtgcaactgctttacatacgagtacaagccatttaatagatttattgctttatttttctggttcagatattgaatatgttgttggagatattcaaaaagattttgtgagaaatgttcacggtatttctgatgtcggaggaacaggaatgataaagtttaagtctaattctattgggttcattaaaggtactagttcttccccaatgaaatatatgtttgaattagacatacttggcgaaaatgggcgaataagattatacaacaatggatcatcttatgatttatataaattttcaagtagtgaaaattcatcaggtagcaagtatgaacatttagatttagtctattcaaaacacaatactactccaaatgaaagaatgatagatgccattttaagtctaattgaaggtattgaaacaggaaaacaacctgtatcaaatataaaaacggcaatagaatcaatagaggttattgaaagtataaaactatcatcaatgaatggaaatataattaaatttcaataaatgagcctctcccacaatttgtgtaaatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacagatggaatttttgggggggtgaaataacctacgcttagtggttaagcgtaggtgtaagcgttaagcggttaagattttatccgctgcgattttagctaagaagttgctacggtttttatactctttgtgaacggcaacaaaatcatcaatgcgtttgatgagatagctagggagggtgatgttgatgcgttcggctttgccgagtaaatggctaatatcaacatcaacaaagccgaaaaagaagtcatattctgcaaaatcagggtttttgcggtggttatcaatggaggttggcatcggaatttcttctccatcttcaactaagccttcaaggtggaacacgatggcttctttgacattttgatatgcttcttcgagggtatcgccagcagagaagcaccctggaatatcaggcacgataacgccgtaagcgtgagtttcgtcacctggttcaattgcaattgggtataacatattttgtccttgtggttatagcagggctattttagccccgcttgtttaagtattgagagttcagttcctttttttaaatcctttttcggatgaggcactgttactcgcccttgtttagttggatgtttgaattgatggtggcttccacttgttgcaactaagtaccaaccgtccgcttcaatcattttaattatggttttgctatccacattattgtgctcctttgttgtttttcatgtgtgtattatacttatttttatgtttttatcaactgtttatatgtaagatgtgtattttaggtgaataaatgaaattttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtattcgagccgaatttggtgaaacattagatgagttattggcagaattaaatgaggggctatgggagaaaatggggtaagtttgaattgttaagaaaaatttaatctaagcagtcgaaaaatacctaaattttgtaaatcagcttgaagctcaagttaatgccgctttggaacgggtaaatttaatgacataagccattttggataaaggatgtcagggatagttgtaaaaatcgtgcaaaaaattggatttatggtacactttagttaatttaacttccaaaaggtggaaattatatgctgtttacctatctttttatcgataatatctataatttctcaaatgcagtgattgattttacgttaaaacgtaaaatcttacacagtgctattgatggagaatttcttgatgaacgccctaattttcgttttaagcgggtttgtattctttctggggctaatgcgagtggtaaaacatcactcggtaaaataatgcgttatattcagcattttattttgttcccaaatagtaatttattaaaacaaatcaatgataaagagaaaaatgggttgataaaagtagaatttgttctacctgaaaataatactattcattatttagaaattgtacagtcaatagcaagaaaatcagaatatcctttaattaaatatgcttcaattcctattttggataaagatactagcacatcagcaagaaagcgtttgatggaattttttgctaaaaaaggaaattcaaatattaagaatggcaattattatgaaactgaagataataatcctatttttttatttgacaatattcgtcaaaagatagcagaaaatttatgtttttattatatgttttctgataatacagataaaagtcaattatctattcaagatggacatttaaatgcgggtattttagaaaccgtacttaaaacgtttgatccctcaattgtttcagttaatgaattacgtaatcaagatgaacttgaaggatatagtattcgttttagtaataaggatagtgtattgattgataaaaatggtgatattcccaataaagatcgtttatcaaaagggacgtttgatgcaattcaagttgctgattttatcgcttttatattacagaatgcagaacaaaataaatcattgaaatctgtttgtgcaatctattttcttgatgaaaaaatggcatatagtcattctgaaattgaacaagcgattgtgaatttaatttcacaaaaaatgatgcgttatgctcaatttatttatacaacgcataattacgatgttttagatttgaatctaccaatacattcatttgttttcttacataagactggcgataaagcagagtttattcaaccagaacaaaaatttaagaaaaatgatcgttcattgcttaattatgttcaaaataatgtattttatactattcctgatacgtcattattagatgaattgttatagggtcttgcggatgaaaaagagaacaacgatccaatttttagtagaaggtcaaacagaacgagaatttattaaagctttaaatttgttaggtaaagtgcagcttattaatttatgggataaggatatttcttctatcttagcgagattaagagctgatgaaatttatattatttatgatacagatgttattcataatatagaacgttttactcgaaatctccgtgttctaaaacaacaaaaaataaagttctttttattacagcaaactaaaaatcttgaagatgagatagttcgttgttctaattgccaaacaattaaagatgtttttggtacgggaataaaagaatttaaagaacaatttttagcgtgcaataaccttgaatataaattagccgaaataggcattaaacatcttgatttatggcaaggtaaacaccttgaacaactttctgaatggaaaaatttaagaagaaaattttctgatttagcctcttcaaaataaggttgattatgacaaataacgaaatagtccaaaaactttggaatttgtgtgatgtgctacgtgatgatggcattaactacaacgactatttaaccgaattggtgatgttgctgtttattaaaatggtgcacgaaaaagagcaattatttattgaagagaaaacagaatttaaaccattattacccgaaggttgccgttgggaagatttaagcggtaaatcaggtatcaatcttttagataactatcgccgtatgttgcttgtgctttcaacgggtaaagaaaatgatgagatcgttcataataacccgttattgttagcgatttatgccaatgcaaaaacctcattaacgcaaccaaagcatttagagcaattagtgcgtaactttgatgaaatggattggttctcggcgcaaaaagatggtttgggcgatttatatgagggattgcttgaaaaaaatgccactgaaacgaaatcaggtgcagggcaatattttacgccacgtgcattgattaactcgatggtacgttgtattaaccccgtggttggagaggtaattcaagatcctgccgctggaacagctggctttttgattgctgccgaccaatatatgcgcaacaaaaccgatgattattttgatttaagcgaacaagatcgtcattttcaaattcacgaagcctttaaaggggtggagttagtgaccaatactcgtcgccttgcgttaatgaactgtttattacacggtattgaaggtggttcagaaggggcggttattcaaggtaacagcttaggtgatgtgggcaaaaatttaaaacctgctgatattatccttgctaatccgccatttggcaccagtaaaggcggtgatgcggtgataacccgtgatgatttaacctttgaaacgactaataaacagctggctttcttgcagcatatctatcgtaatttaaaagaaggtggacgtgcggcggtggtgttgccggataatgttttgtttgaagccggtaaagggacggatattcgcaaagatttaatggataaatgtcatttgcatacgattttgcgtttaccaacggggattttttatgctcagggtgtgaaaaccaatgtgctgttttttgacaaagtcagtaacgatgcggaaaattcaactcaaaaaacgtgggtttatgatttacgtacaaatatgccgagctttggtaagcgtactccgtttacagaaaaataccttgaagcctttgaaaaggtatttaatccgaccgaacttgatgtcaataaagcgaatataacgatgattttgagtgctcgccaagaaggggagtggagctataccgaaggggaacaaacagcggaaaatagtcgttggaaatgttttgatcgcacttatattcgagatgtaaaaggcgatagtttagatattagctggcttaaagataatgctgctgttagcagtgaagatttgcctgagccagaagagctgattgcggaagcaaaagccgaattggaagcagcccttgcagggttagatgaactattcgcagaattaaccacaaaataggataaacaaaatgttagccaaattagaccgcttgctccgtcaagcaaacattcctttgaccgatcagcaaaaacagcagttggttgatttcgtgaaattattggataaatggaacaaggcgtataacctcacttctgtgcgtaatcccgatgaaatgttggttaagcatattatggatagccttgtggtaagccaacatttacaggggcaacagtttattgatgtgggaacaggtccggggttaccgggtattccgctggcgatagctaatccagataagcagtttgtgttgttagatagcttaggcaaacgcattacctttatcaaaaatgccattcgtgagctaaaactcaccaatgtcactcctgtgctaagtcgggttgaagagtatcaagagcaacaatttgacggcgtattaagccgagcttttgcttctctaaatgatatggttgattggtgttaccatttgccgaatacaagcggtcacttttatgcgttaaaaggacaatatcagccagaagaattggcagaagtgagcaaaccgattgagttagtggacgtaattaaattgaacgtacctgagttagtcggagagcgacatttggtggtattgaatagataataataggtacagtggtagtgtaatagacaaaatagttttcaaaaagtagattaattccttgtaatatagtgctaattcaacttttagtaaccattttgtctactatgttttttcttccaacccctatcttcctgccctcgccacaaacgctgaatattatcgtgatggcgatagactaatagacaacaaactaatgcgacagggaatgttaattcagagctaaaccaccaaatataaagtggaacgatcaatgctgtaataactgcacttagcgatgaataaccagaaatcaaaaaaacgaacaaccacgttcccaccgctaatccagcaactgaatagcccattggaatgattgctccaaaggcagttgcaacccctttgccacctcggaacttaaagaaaacggggaaaatatgtccaagacaagctgccaaagcaataaagccaatcaccgaaattggcagttctaaataaaaaccaagagaaacaggtagcataccttttaagatgtccgccattaaaacacctaatgccgataactttccgcctatgcgtaggacgtttgttgccccagggttatgtgatccgtgttctcgtggatcgggtagtcctgctaatcgacaaaaaatgacggcacttgaaatagaaccaagcaaatatgcccctaaaatcagtaaataagcaataacgctcattttttccccttatttgttgcttactttgtgctatattttaccttaactttcaaaaagaaaaacaaggaaagatccgatgactgataaagtttttattcacgaactcaccgcttttgcctctattggggcttatgagtgggaacataccattaaacaacgtttagttttcaatattgaaatggcgtgggattttagccgagccgtcgcagatgatgatgtgcaatactgcttaaattatgcggaagtttcacaaaagattcttgattttgttgaaaatacaccgtttaagttggttgaaaccgttgcttatcgagtggccgaactactgcaacacgagtttggggtgaaatcattacgcattgaattacacaagcctaaagcagttgctcaatcctcaagtgttggtgtaattgttgaacgataaagcgtactattattactaaatgcgatctagatcacagttatcccattgatttctcattataattttcgcccctaatttttagcataaaggagcattctatgcctacaatgatcgatatccaagaacgtttaatcgaacttgttgcagaaaaacaaagccctgttgttcaagcggttgtggagcagttaattcgacaaaacaataaagcatacttttctgcagaacaagtcaccacattttgtcaaacattcaacctatcccctgtcgaacttgctttagaatgcttacctattgcggcttgctacgccagagtgcctgtttctcatttttttgtaggggctgtggcgatt
